US012679868B2

(12) United States Patent
Holder et al.

(10) Patent No.: US 12,679,868 B2
(45) Date of Patent: Jul. 14, 2026

(54) APELIN POLYPEPTIDES

(71) Applicant: AMGEN INC., Thousand Oaks, CA (US)

(72) Inventors: Jerry Ryan Holder, Simi Valley, CA (US); Gayathri Swaminath, Brisbane, CA (US); Michael J. Frohn, Thousand Oaks, CA (US); Brian Alan Lanman, Woodland Hills, CA (US); Anthony B. Reed, Newbury Park, CA (US); Leslie P. Miranda, Thousand Oaks, CA (US); John Gordon Allen, Newbury Park, CA (US); Alexander J. Pickrell, Westlake Village, CA (US); Aaron C. Siegmund, Ventura, CA (US); Lewis D. Pennington, Arlington, MA (US); Bryant Yang, Agoura Hills, CA (US)

(73) Assignee: AMGEN INC., Thousand Oaks, CA (US)

( * ) Notice: Subject to any disclaimer, the term of this patent is extended or adjusted under 35 U.S.C. 154(b) by 0 days.

(21) Appl. No.: 18/497,081

(22) Filed: Oct. 30, 2023

(65) Prior Publication Data

US 2024/0327461 A1 Oct. 3, 2024

Related U.S. Application Data

(60) Continuation of application No. 17/160,819, filed on Jan. 28, 2021, now Pat. No. 11,807,693, which is a division of application No. 15/317,911, filed as application No. PCT/US2015/035205 on Jun. 10, 2015, now Pat. No. 10,941,182.

(60) Provisional application No. 62/010,322, filed on Jun. 10, 2014.

(51) Int. Cl.

| | |
|---|---|
| ***C07K 7/08*** | (2006.01) |
| ***A61K 38/00*** | (2006.01) |
| ***A61K 38/10*** | (2006.01) |
| ***A61K 47/54*** | (2017.01) |
| ***A61K 47/60*** | (2017.01) |
| ***C07K 14/47*** | (2006.01) |

(52) U.S. Cl.

CPC ................ *C07K 7/08* (2013.01); *A61K 38/10* (2013.01); *A61K 47/542* (2017.08); *A61K 47/60* (2017.08); *C07K 14/47* (2013.01); *A61K 38/00* (2013.01); *C07K 2319/30* (2013.01)

(58) Field of Classification Search

CPC ...... C07K 7/08; C07K 14/47; C07K 2319/30; A61K 38/10; A61K 47/542; A61K 47/60; A61K 38/00; A61P 9/00; A61P 9/04; A61P 9/12

See application file for complete search history.

(56) References Cited

U.S. PATENT DOCUMENTS

| | | | |
|---|---|---|---|
| 3,691,016 | A | 9/1972 | Patel |
| 3,941,763 | A | 3/1976 | Sarantakis |
| 3,969,287 | A | 7/1976 | Jaworek et al. |
| 4,195,128 | A | 3/1980 | Hildebrand |
| 4,229,537 | A | 10/1980 | Hodgins et al. |
| 4,247,642 | A | 1/1981 | Hirohara et al. |
| 4,330,440 | A | 5/1982 | Ayers et al. |
| 4,351,337 | A | 9/1982 | Sidman |
| 4,847,325 | A | 7/1989 | Shadle et al. |
| 4,925,673 | A | 5/1990 | Steiner et al. |
| 5,002,936 | A | 3/1991 | Lieberman et al. |
| 5,013,556 | A | 5/1991 | Woodle et al. |
| 5,166,322 | A | 11/1992 | Shaw et al. |
| 5,171,264 | A | 12/1992 | Merrill |
| 5,206,344 | A | 4/1993 | Katre et al. |
| 5,252,714 | A | 10/1993 | Harris et al. |
| 5,284,656 | A | 2/1994 | Platz et al. |
| 5,446,090 | A | 8/1995 | Harris |
| 5,643,575 | A | 7/1997 | Martinez et al. |
| 5,714,142 | A | 2/1998 | Blaney et al. |
| 5,739,208 | A | 4/1998 | Harris |
| 5,770,559 | A | 6/1998 | Manning et al. |
| 5,792,451 | A | 8/1998 | Sarubbi et al. |
| 5,824,784 | A | 10/1998 | Kinstler et al. |
| 5,900,461 | A | 5/1999 | Harris |
| 5,919,455 | A | 7/1999 | Greenwald et al. |
| 5,932,462 | A | 8/1999 | Harris et al. |
| 5,981,474 | A | 11/1999 | Manning et al. |
| 5,985,265 | A | 11/1999 | Kinstler et al. |
| 5,990,237 | A | 11/1999 | Bentley et al. |
| 6,245,740 | B1 | 6/2001 | Goldenberg et al. |
| 6,342,225 | B1 | 1/2002 | Jones |

(Continued)

FOREIGN PATENT DOCUMENTS

| | | |
|---|---|---|
| EP | 0668353 A1 | 8/1995 |
| EP | 0668354 A1 | 8/1995 |

(Continued)

OTHER PUBLICATIONS

Tuomas Peltonen, Apelin and its Receptor APJ in Human Aortic Valve Stenosis, J Heart Valve Dis 645 vol. 18. No. 6 Nov. 2009.*
Abuchowski and Davis, "Soluble Polymer-Enzyme Adducts, Enzymes as Drugs", Hocenberg and Roberts, eds., Wiley-Interscience, New York, New York, pp. 367-383, 1981 Newmark et al., J. Appl. Biochem., 4:185-189, 1982.
Adjei et al., Pharma. Res. (1990) 7: 565-569.
Adjei et al., "Bioavailability of leuprolide following intratracheal administration to beagle dogs," *International Journal of Pharmaceutics* 61(1-2): 135-44 (1990).

(Continued)

*Primary Examiner* — Erinne R Dabkowski
(74) *Attorney, Agent, or Firm* — Lisa E. Alexander

(57) ABSTRACT

The invention provides modified apelin polypeptides having increased stability, circulating half-life, and/or potency relative to the native apelin-13 polypeptide. Compositions comprising the modified apelin polypeptides and methods of using the polypeptides for treating cardiac disorders, such as heart failure, are also disclosed.

13 Claims, 15 Drawing Sheets

Specification includes a Sequence Listing.

(56) References Cited

U.S. PATENT DOCUMENTS

| | | | |
|---|---|---|---|
| 6,451,986 | B1 | 9/2002 | Petit |
| 6,548,644 | B1 | 4/2003 | Petit |
| 6,552,170 | B1 | 4/2003 | Thompson et al. |
| 6,602,498 | B2 | 8/2003 | Shen |
| 6,610,281 | B2 | 8/2003 | Harris |
| 6,660,843 | B1 | 12/2003 | Feige et al. |
| 6,887,470 | B1 | 5/2005 | Bridon et al. |
| 6,887,487 | B2 | 5/2005 | Murthy et al. |
| 6,894,025 | B2 | 5/2005 | Harris |
| 6,900,317 | B2 | 5/2005 | Trunk et al. |
| 6,926,898 | B2 | 8/2005 | Rosen et al. |
| 2002/0119946 | A1 | 8/2002 | Gen |
| 2003/0069395 | A1 | 4/2003 | Sato et al. |
| 2003/0191056 | A1 | 10/2003 | Walker et al. |
| 2003/0195154 | A1 | 10/2003 | Walker et al. |
| 2005/0054051 | A1 | 3/2005 | Rosen et al. |
| 2006/0199812 | A1 | 9/2006 | D'Amico et al. |
| 2007/0071764 | A1 | 3/2007 | Sullivan et al. |
| 2014/0155315 | A1 | 6/2014 | Zecri et al. |

FOREIGN PATENT DOCUMENTS

| | | | |
|---|---|---|---|
| EP | 0473084 | B1 | 11/1995 |
| EP | 0469074 | B1 | 7/1996 |
| EP | 1116727 | B1 | 3/2003 |
| EP | 0575545 | B1 | 5/2003 |
| WO | 1995/013312 | A1 | 5/1995 |
| WO | 1996/032478 | A1 | 10/1996 |
| WO | 1997/034631 | A1 | 9/1997 |
| WO | 2000/038652 | A1 | 7/2000 |
| WO | 2004/017918 | A2 | 3/2004 |
| WO | 2004/110472 | A2 | 12/2004 |
| WO | 2005/105057 | A1 | 11/2005 |
| WO | 2006/042151 | A2 | 4/2006 |
| WO | 2006/076736 | A2 | 7/2006 |
| WO | 2007/022070 | A2 | 2/2007 |
| WO | 2008/088422 | A2 | 7/2008 |
| WO | 2009/043504 | A2 | 4/2009 |
| WO | 2010/108153 | A2 | 9/2010 |
| WO | 2012/040518 | A2 | 3/2012 |
| WO | 2012/075037 | A1 | 6/2012 |
| WO | 2012/125408 | A1 | 9/2012 |
| WO | 2013/079487 | A1 | 6/2013 |
| WO | 2013/106437 | A1 | 7/2013 |
| WO | 2014/099984 | A1 | 6/2014 |
| WO | 2014/152955 | A1 | 9/2014 |

OTHER PUBLICATIONS

Anonymous, Apelin precursor, UniProt protein database, accessed on May 16, 2019, protein Accession Q9ULZ1, 12 pages.

Anonymous, N-Terminal Acetylation and C-Terminal Amidation of Peptides, Technical Bulletin, Thermo Electron Corporation, 2 pages, 2004.

Araghi et al., "A systematic study of fundamentals in α-helical coiled coil mimicry by alternating sequences of β-and γ-amino acids," *Amino Acids* 41:733-742 (2011).

Barnes et al., "Translational promise of the apelin-APJ system," *Heart* 96(13):1011-1016 (2010).

Beeton et al., "Targeting effector memory T cells with a selective peptide inhibitor of Kv1.3 channels for therapy of autoimmune diseases," *Molec. Pharmacol*. 67(4):1369-1381 (2005).

Bennet et al., Eds., Advanced Chemtech Handbook of Combinatorial & Solid Phase Organic Chemistry, Advanced Chemtech, 1998.

Berry et al., "Apelin has in vivo inotropic effects on normal and failing hearts," *Circulation* 110(11_suppl_1):187-193 (2004).

Bhatnagar et al., "Structure—activity relationships of novel hematoregulatory peptides," *J. Med. Chem*., 39:3814-3819 (1996).

Biron et al., "Optimized selective N-methylation of peptides on solid support," *J. Peptide Sci*. 12(3):213-219 (2006).

Bodanszky, Ed., Principles of Peptide Synthesis, 2nd ed., Springer-Verlag, 1993.

Bodanszky and Bodanszky, Eds., "The Practice of Peptide Synthesis, 2nd ed.," Springer-Verlag, 1994.

Brame et al., "Design, Characterization, and First-In-Human Study of the Vascular Actions of a Novel Biased Apelin Receptor Agonist," *Hypertension* 65(4):834-840 (2015).

Braquet et al., "Effect of Endothelin-1 on Blood Pressure and Bronchopulmonary System of the Guinea Pig," *J. Cardiovasc. Pharmacol*. 13 (suppl.5): S143-146 (1989).

Chan and White, Eds., Fmoc Solid Phase Peptide Synthesis, A Practical Approach, Oxford Press, 2000, pp. x-xv.

Creighton, Proteins: Structure and Molecule Properties, W. H. Freeman & Co., San Francisco, 79-86, 1983.

Davis et al., "Preparation and characterization of antibodies with specificity for the amino-terminal tetrapeptide sequence of the platelet-derived connective tissue activating peptide-III," *Biochemistry International* 10(3):395-404 (1985).

Debs et al., "Lung-specific delivery of cytokines induces sustained pulmonary and systemic immunomodulation in rats," *J. Immunol*. 140(10): 3482-3488 (1988).

Delgado et al., "The uses and properties of PEG-linked proteins", *Crit. Rev. Therap. Drug Carrier Systems* 9(3-4):249-304 (1992).

Dennis et al., "Albumin binding as a general strategy for improving the pharmacokinetics of proteins," J.Biol. Chem. 277(38):35035-35043 (2002).

Ehrlich et al., "Preparation and Characterization of Albumin Conjugates of a Truncated Peptide YY Analogue for Half-Life Extension," *Bioconjugate Chem*. 24(12):2015-2024 (2013).

Erickson et al., "Solid-Phase Peptide Synthesis," The Proteins, 3rd ed., 2: 255-527, 1976.

Felix et al., "Pegylated Peptides IV: Enhanced biological activity of site-directed pegylated GRF analogs," *Int. J. Peptide Protein Res*. 46(3-4):253-264 (1995).

Felix, "Sitespecific Poly(ethylene glycol)ylation of Peptides," *ACS Symposium Series* 680: 218-238 (1997).

Fields et al., Synthetic Peptides: A User's Guide, 77-129, 1992.

Finn et al., "The Synthesis of Peptides by Solution Methods with Emphasis on Peptide Hormones," The Proteins, 3rd ed., 2:105-253, 1976.

Gillespie et al., Histamine release from rat peritoneal mast cells: inhibition by colchicine and potentiation, 1968; 154-1.

Goodson and Katre, "Site-Directed Pegylation of Recombinant Interleukin-2 at its Glycosylation Site," *Bio/Technology* 8:343-346 (1990).

Greene and Wuts, Eds., Protecting Groups in Organic Synthesis, 3rd ed., John Wiley & Sons, Inc., 1999.

Greenwald et al., "Poly(ethylene glycol) Conjugated Drugs and Prodrugs: A Comprehensive Review," *Critical Reviews in Therapeutic Drug Carrier* Systems 17(2):101-161 (2000).

Gregoriadis et al., "Improving the therapeutic efficacy of peptides and proteins: a role for polysialic acids," *Intl. J. Pharmaceutics* 300(1-2):125-130 (2005).

Herman et al., "Poly(ethylene glycol) with reactive endgroups: I. Modification of proteins," *J. Bioactive Compatible Polymers* 10:145-187 (1995).

Hosoya et al., "Molecular and functional characteristics of APJ : tissue distribution of mRNA and interaction with the endogenous ligand apelin," *J. Biol. Chem*. 275(28): 21061-21067 (2000).

Hubbard et al. "Anti-Neutrophil-Elastase Defenses of the Lower Respiratory Tract in α1-Antitrypsin Deficiency Directly Augmented with an Aerosol of α1-Antitrypsin," *Annals Int. Med*. 3: 206-212 (1989).

Iida et al., "Two mechanisms of the enhanced antibody-dependent cellular cytotoxicity (ADCC) efficacy of non-fucosylated therapeutic antibodies in human blood," *BMC Cancer* 9:58, 2009, doi:10.1186/1471-2407-9-58.

Jia et al., "Cardiovascular effects of a PEGylated apelin," *Peptides* 38:181-188 (2012).

Kenyon et al., "13C NMR Studies of the binding of medium-chain fatty acids to human serum albumin," *J. Lipid Res*. 35(3):P458-467 (1994).

Knudsen et al., "Potent Derivative of Glucagon-like Peptide-1 with Pharmacokinetic Properties Suitable for Once Daily Administration," *J. Med. Chem*. 43(9):1664-1669 (2000).

(56) References Cited

OTHER PUBLICATIONS

Kocienski, Ed., Georg Thieme Verlag, "Protecting Groups," Stuttgart, Germany, 1994.
Kratz, "Albumin as a drug carrier: Design of prodrugs, drug conjugates and nanoparticles," *J. Controlled Release* 132(3):171-183 (2008).
Kurtzhals et al., "Albumin binding of insulins acylated with fatty acids: characterization of the ligand-protein interaction and correlation between binding affinity and timing of the insulin effect in vivo," *Biochem. J.* 312(3):725-731 (1995).
Kyte et al., "A simple method for displaying the hydropathic character of a protein," *J. Mol. Biol.* 157(1):105-132 (1982).
Link et al., "Non-canonical amino acids in protein engineering," *Current Opinion in Biotech.* 14(6):603-609 (2003).
Lu et al.,"Pegylated peptides III: Solid-phase synthesis with pegylating reagents of varying molecular weight: synthesis of multiply pegylated peptides," *Reactive Polymers* 22(3):221-229 (1994).
MacLennan et al., "Structure-function relationships in the Ca (2+)-binding and translocation domain of SERCA1: physiological correlates in Brody disease," *Acta Physiol. Scand. Suppl.* 643:55-67 (1998).
Maguire et al., "Apelin-13 Identified as the Predominant Apelin Isoform in the Human Heart: Vasoactive Mechanisms and Inotropic Action in Disease," *Hypertension* 54(3):598-604 (2009).
Maniatis et al., Molecular Cloning. A Laboratory Manual. Cold Spring Harbor Laboratory, Cold Spring Harbor, N.Y., 1982, pp. 387-389.
Margathe et al., "Structure-Activity Relationship Studies toward the Discovery of Selective Apelin Receptor Agonists" *Journal of Medicinal Chemistry* 57(7): 2908-2919 (2014), XP055257810, US ISSN: 0022-2623,001: 10.1021/jm401789v.
Marshall, Modern Pharmaceutics (1979), edited by G. S. Banker and C. T. Rhodes, in Chapter 1, pp. 359-427.
Means et al., "Selected techniques for the modification of protein side chains, in: Chemical modification of proteins", Holden Dday, Inc., pp. 214-229, 1971.
Merrifield, Chem. Polypeptides, Katsoyannis and Panayotis eds., pp. 335-361, 1973.
Merrifield, "Solid Phase Peptide Synthesis. I. The Synthesis of a Tetrapeptide," *J. Am. Chem. Soc.* 85: 2149-2154 (1963).
Morpurgo et al., "Preparation and Characterization of Poly(ethylene glycol) Vinyl Sulfone," *Bioconj. Chem.* 7(3):363-368 (1996).
Murza et al., "Elucidation of the Structure-Activity Relationships of Apelin: Influence of Unnatural Amino Acids on Binding, Signaling, and Plasma Stability," *ChemMedChem* 7(2): 318-325 (2012), XP55072892, ISSN: 1860-7179, 001: 10.1 002/cmdc.2011 00492.
Murza et al., "Stability and Degradation Patterns of Chemically Modified Analogs of Apelin-13 in Plasma and Cerebrospinal Fluid," *PeptideScience* 102(4):297-303 (2014).
Newmark et al., "Preparation and Properties of Adducts of Streptokinase and Streptokinase-Plasmin Complex with Polyethylene Glycol and Pluronic Polyol F38," *J. Appl. Biochem.* 4(2):185-189 (1982).
Nishizawa et al., Peptide Science 37:151-157, 2001.
Oeswein et al., "Aerosolization of Proteins," Proc. Symp. Resp. Drug Delivery II, Keystone, Colorado (recombinant human growth hormone), pp. 14, 16-34, figures 1-14 (1990).
Pennington et al., "Engineering a stable and selective peptide blocker of the Kv1.3 channel in T lymphocytes," *Molec. Pharmacol.* 75(4):762-773 (2009).
Sandler and Karo, Polymer Synthesis, Academic Press, New York, 3:138-161, 1980.
Sasaki et al., "Structure-mutation analysis of the ATPase site of Dictyostelium discoideum myosin II," *Adv. Biophys.* 35(3):1-24 (1998).
Scanlon et al., "Comprehensive N-Methyl Scanning of a Potent Peptide Inhibitor of Malaria Invasion into Erythrocytes Leads to Pharmacokinetic Optimization of the Molecule," *Int. J. Pept. Res. Ther.* 14:381-386 (2008).
Sidorova et al., "Synthesis and Cardioprotective Properties of Apelin-12 and its Structural Analogues," *Russian Journal of Bioorganic Chemistry* 38(1):30-40 (2012).
Smith et al. "Pulmonary deposition and clearance of aerosolized alpha-1-proteinase inhibitor administered to dogs and to sheep," J. Clin. Invest. 84(4): 1145-1154 (1989).
Stewart and Young, Solid Phase Peptide Synthesis, Freeman and Co., 1969.
Taheri et al., "The Effects of Centrally Administered Apelin-13 on Food Intake, Water Intake and Pituitary Hormone Release in Rats," *Biochemical and Biophyiscal Research Communications* 291(5):1208-1212 (2002).
Tatemoto et al., "Isolation and characterization of a novel endogenous peptide ligand for the human APJ receptor," *Biochem. Biophys. Res. Commun.* 251(2):471-476 (1998).
Watt, "Mast cells and peptide induced histamine release," *InflammoPharmacology* 9:421-434 (2001).
Zalipsky et al., "Use of Functionalized Poly(Ethylene Glycol)s for Modification of Polypeptides," Poly(Ethylene Glycol) Chemistry: Biotechnical and Biomedical Applications, J.M. Harris, Ed., Plenum Press: New York, 347-370, 1992.
Zalipsky, "Chemistry of polyethylene glycol conjugates with biologically active molecules," *Advanced Drug Delivery Reviews* 16(2-3):157-182 (1995).
Zhang et al., "Identifying structural determinants of potency for analogs of apelin-13: Integration of C-terminal truncation with structure-activity," *Bioorganic & Medicinal Chemistry* 22(11): 2992-2997 (2014), XP028660063, ISSN: 0968-0896, 001: 10.1 016/J. BMC.2014.04.001.
Fischer et al., "Plasma kallikrein cleaves and inactivates apelin-17: Palmitoyl- and PEG-extended apelin-17 analogs as metabolically stable blood pressure-lowering agents", European Journal of Medicinal Chemistry, vol. 166, Mar. 15, 2019, pp. 119-124.

* cited by examiner homo-Arginine

N-methyl Arginine

Cyclohexylalanine

N-methyl Leucine

Norleucine

Octahydroindole-2-carboxylic acid

4-Chloro Phenylalanine

D-Biphenylalanine

R=H, acetyl, acyl, peptide

R=H, acetyl, acyl, peptide

Synthetic Strategies to Further Stabilize Peptide Agonists by Backbone Modifications N-methyls D-amino acids β-amino acids Reduced amide bond N-alkyl glycines α-Methyls Cyclized

APELIN POLYPEPTIDES

CROSS-REFERENCE TO RELATED APPLICATIONS

This application is a continuation application of U.S. patent application Ser. No. 17/160,819, filed on Jan. 28, 2021, now U.S. Pat. No. 11,807,693, issued on Nov. 7, 2023, which is a divisional application of U.S. patent application Ser. No. 15/317,911, filed on Dec. 9, 2016, now U.S. Pat. No. 10,941,182, issued on Mar. 9, 2021, which is a national stage application under 35 U.S.C. § 371 of International Application No. PCT/US2015/035205, having an international filing date of Jun. 10, 2015, which claims the benefit of, and priority to, U.S. Provisional Patent Application No. 62/010,322, filed on Jun. 10, 2014, the entire disclosures of which are hereby incorporated by reference in their entirety for all purposes.

INCORPORATED BY REFERENCE OF MATERIAL SUBMITTED ELECTRONICALLY

Incorporated by reference in its entirety is a computer-readable nucleotide/amino acid sequence listing submitted concurrently herewith and identified as follows: 3,841,249 bytes xml file named "A-1909-US04-CNT_SL.xml"; created on May 21, 2024.

FIELD OF THE INVENTION

The application relates to agonists of the APJ receptor that have increased stability, circulating half-life and/or potency relative to native apelin.

BACKGROUND OF THE INVENTION

Apelin is the endogenous ligand for the APJ receptor (APLNR, angiotensin receptor like-1). The APJ receptor is a member of the rhodopsin-like G protein-coupled receptor (GPCR) family. The apelin/APJ system has been observed in many tissues such as heart, kidney, pancreas, lung and the central nervous system, suggesting diverse roles of the system in the physiology and pathology of mammals.

Apelin peptides are processed from a 77 residue pre-pro form into smaller bioactive fragments, mainly a 36 residue form (Apelin 42-77—also referred to as Apelin-36) and a smaller 13 residue polypeptide (Apelin 65-77—also referred to as Apelin-13) (Hosoya et al., J. Biol. Chem. 275:21061-21067, 2000). Apelin peptides were previously determined to be endogenous ligands for the orphan APJ receptor, a member of the seven transmembrane G-protein-coupled receptor superfamily (Tatemoto et al., Biochem. Biophys. Res. Commun., 251:471-476, 1998). One of the shorter more active isoforms identified, pyroglutamated apelin-13 ([PE65]Apelin-13 (65-77)), has been reported to be the most potent and abundant form of apelin in cardiac tissue (Maguire et al., Hypertension, 54:598-604, 2009). In vitro and preclinical models have suggested that the apelin/APJ system has a role in cardiovascular homeostasis as well as metabolism (Barnes et al., Heart, 96:1011-1016, 2010). Circulating apelin levels are transient and Apelin-13 has a brief plasma half-life of <5 minutes leading to short-lived cardiovascular effects.

In vitro, exogenous apelin increases contractility at subnanomolar concentrations in atrial strips and whole rat hearts, and increases sarcomere shortening by up to 140% in isolated cardiomyocytes (Barnes et al., Heart, 96:1011-1016, 2010). Apelin also has a potent inotropic effect in an ex-vivo isolated heart assay. In vivo, acute apelin infusion restores ejection fraction, increases cardiac output and reduces left ventricular end-diastolic pressure in rats with chronic heart failure (Berry et al., Circulation, 110:187-193, 2004). Exogenous apelin potently enhances myocardial contractility without inducing left ventricular hypertrophy concomitant with reduction in ventricular preload and afterload (Barnes et al., Heart, 96:1011-1016, 2010).

There have been very limited structure activity relationship (SAR) studies reported for apelin peptides. The limited SAR studies have focused on in vitro affinity and/or potency enhancement. There are no reports with SAR focused on increasing proteolytic stability and prolonging circulating half-lives while improving or maintaining potency of APJ agonists.

Thus, there is a need in the art for novel apelin analogs that retain the potency of native apelin polypeptides but have increased stability.

SUMMARY OF THE INVENTION

The present invention provides novel modified apelin polypeptides that have APJ agonist activity. In some embodiments, the modified peptides have increased stability relative to wild-type apelin. The modified peptides of the invention can be used to treat heart failure or other disorders that respond to activation of the APJ receptor.

In certain embodiments, the modified apelin polypeptides have advantageous pharmaceutical characteristics, such as increased stability, half-life, and/or potency. In some embodiments, the modified apelin polypeptides comprise at least one D-amino acid, a n-amino acid, an N-methyl amino acid, an α-methyl amino acid, a non-canonical amino acid or the D- or β-form of the non-canonical amino acid. In one embodiment, the modified apelin polypeptide comprises two or more, three or more, four or more, five or more, six or more, seven or more, or eight or more non-canonical amino acid residues. In certain embodiments, the non-canonical amino acid residues replace canonical amino acid residues within the apelin polypeptide sequence. The modified apelin polypeptides may be cyclized to further enhance stability.

In one embodiment, the apelin polypeptide comprises the amino acid sequence: $X_1$ $X_2$ $X_3X_4$ $X_5$ $X_6$ $X_7$ $X_8$ $X_9X_{10}GX_{11}X_{12}$ $X_{13}$ $X_{14}$ (SEQ ID NO: 717), wherein: $X_1$ is R, E, [hArg], or absent; $X_2$ is [r], R, E, [hArg], or absent; $X_3$ is Q, [q], or [BLeu]; $X_4$ is [hArg], [NMeArg], R, E, or [r]; $X_5$ is P or [aMePro]; $X_6$ is R, E, [r], [hArg] or [NMeArg]; $X_7$ is L, [aMeLeu], [BLeu], [NMeLeu] or [Cha]; $X_8$ is S, [BhSer], or [NhSerG]; $X_9$ is H or Y; $X_{10}$ is K or [NLysG]; $X_{11}$ is P, [Oic], [aMePro], or [Pip]; $X_{12}$ is [Nle], [rNle], or [pI-Phe]; $X_3$ is P, [BhPro], [aMePro], or [Aib]; and $X_{14}$ is F, [D-BhPhe], [4-Cl-F], [D-4ClF], or [D-Bip]. In some embodiments, $X_7$ is [NMeLeu], $X_{12}$ is [pI-Phe], and $X_{14}$ is [D-Bip]. In certain embodiments, $X_1$ is [hArg], $X_2$ is [hArg], $X_3$ is Q, $X_4$ is [hArg], and $X_5$ is P. In other embodiments, $X_{13}$ is [BhPro], [aMePro], or [Aib] and $X_{14}$ is [D-BhPhe] or [4-Cl-F]. In certain embodiments, $X_6$ is [NMeArg] or [hArg] and $X_7$ is [aMeLeu] or [BLeu]. The modified apelin polypeptide may be acetylated at its amino terminus. The apelin polypeptide preferably has very little or no antagonist activity against the APJ receptor (i.e. the apelin polypeptide is a full APJ receptor agonist).

In some embodiments, the modified apelin polypeptides may be conjugated, optionally through a linker, to another moiety, such as a fatty acid or other lipid, a polymer (e.g. polyethylene glycol polymer), protein (e.g. an antibody or Fc domain), or another peptide sequence (e.g. a targeting domain) that serves as a half-life extension moiety. These half-life extension moiety-apelin peptide conjugates may have one or more improved properties, such as stability, in vivo half-life, or potency, relative to native apelin peptides. The moiety may be conjugated to the apelin polypeptide through the N- or C-terminus, or any other site of the polypeptide. In certain embodiments, the half-life extension moiety is conjugated to the N-terminus of the modified apelin polypeptide.

In some embodiments, the modified apelin polypeptides or conjugates thereof have increased in vitro or in vivo stability relative to native Apelin-13 (SEQ ID NO: 4) or pyr-Apelin-13 (SEQ ID NO: 6). In various embodiments, the modified apelin polypeptide with increased stability has an increased in vitro half-life. In other embodiments, the modified apelin polypeptide with increased stability has an increased in vivo half-life. The increased in vivo half-life may be a result of decreased proteolysis or increased metabolic stability and/or inclusion of a half-life extension moiety or other modifications of the apelin polypeptides.

The present invention also includes pharmaceutical compositions comprising the modified apelin polypeptides or conjugates thereof described herein and a pharmaceutically acceptable carrier. The pharmaceutical compositions can be administered to a subject in need of treatment for a cardiovascular disorder, such as heart failure.

Thus, in another embodiment, the present invention provides methods of treating a cardiovascular disorder, improving cardiac contractility, or increasing ejection fraction in a subject in need thereof comprising administering to the subject a pharmaceutical composition comprising a therapeutically effective amount of any of the modified apelin polypeptides or conjugates thereof described herein. In some embodiments, the cardiovascular disorder is heart failure. The heart failure may be acute heart failure or chronic heart failure (e.g., chronic systolic or chronic diastolic). In one embodiment, the heart failure is heart failure with reduced ejection fraction. In another embodiment, the heart failure is heart failure with preserved ejection fraction. In other embodiments, the cardiovascular condition is hypertension.

BRIEF DESCRIPTION OF THE DRAWINGS

FIG. 4A shows percentage change over vehicle in left ventricular systolic pressure. FIG. 4B shows percentage change over vehicle in developed left ventricular pressure. FIG. 4C shows percentage change over vehicle in maximum rate of pressure change in the left ventricle. FIG. 4D shows percentage change over vehicle in minimum rate of pressure change in the left ventricle. 2 out of 8 rats did not respond, but data includes all 8 rats. One way ANOVA analysis: ****<0.0001.

FIG. 5A shows percentage change over vehicle in developed left ventricular pressure. FIG. 5B shows percentage change over vehicle in maximum rate of pressure change in the left ventricle. FIG. 5C shows percentage change over vehicle in left ventricular systolic pressure. FIG. 5D shows percentage change over vehicle in minimum rate of pressure change in the left ventricle.

FIG. 6A shows percentage change from baseline in ejection fraction (EF) at three different dosages of pyr-apelin. FIG. 6B shows percentage change from baseline in maximum rate of pressure change in the left ventricle (dP/dtmax) at three different dosages of pyr-apelin. FIG. 6C shows percentage change from baseline in mean arterial pressure (MAP) at three different dosages of pyr-apelin. FIG. 6D shows percentage change from baseline in heart rate (HR) at three different dosages of pyr-apelin.

FIG. 7A shows percentage change from baseline in ejection fraction (EF) at two different dosages of the apelin polypeptide. FIG. 7B shows percentage change from baseline in maximum rate of pressure change in the left ventricle (dP/dtmax) at two different dosages of the apelin polypeptide. FIG. 7C shows percentage change from baseline in heart rate (HR) at two different dosages of the apelin polypeptide. FIG. 7D shows percentage change from baseline in mean arterial pressure (MAP) at two different dosages of the apelin polypeptide.

FIG. 8A shows percentage change from baseline in ejection fraction (EF) at two different dosages of the apelin polypeptide. FIG. 8B shows percentage change from baseline in maximum rate of pressure change in the left ventricle (dP/dtmax) at two different dosages of the apelin polypeptide. FIG. 8C shows percentage change from baseline in mean arterial pressure (MAP) at two different dosages of the apelin polypeptide. FIG. 8D shows percentage change from baseline in heart rate (HR) at two different dosages of the apelin polypeptide.

FIG. 10A shows the plasma concentrations over time for different lipids conjugated to the same peptide sequence. FIG. 10B shows the plasma concentrations over time for different lipids conjugated to different peptide sequences.

DETAILED DESCRIPTION

Figure 1:
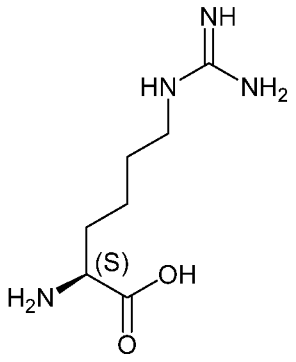
FIG. 1. Structures of exemplary non-canonical amino acids.
Figure 1:
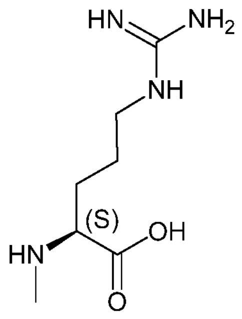
Figure 1:
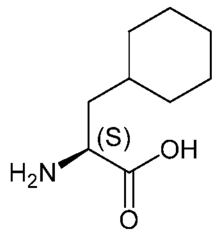
Figure 1:
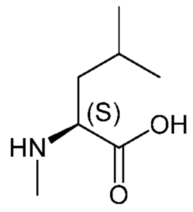
Figure 1:
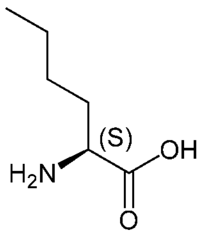
Figure 1:
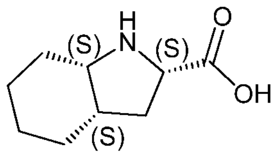
Figure 1:
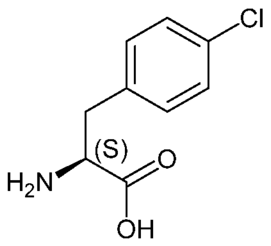
Figure 1:
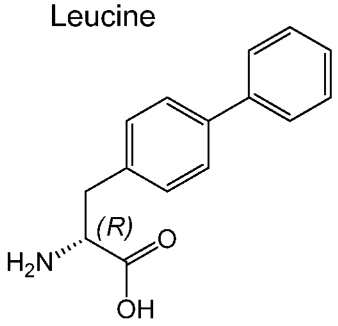

The foregoing summary is not intended to define every aspect or embodiment of the invention, and additional aspects may be described in other sections. The entire document is intended to be related as a unified disclosure, and it should be understood that all combinations of features described herein may be contemplated, even if the combination of features is not found together in the same sentence, or paragraph, or section of this document.

In addition to the foregoing, as an additional aspect, all embodiments narrower in scope in any way than the variations defined by specific paragraphs herein can be included in this disclosure. For example, certain aspects are described as a genus, and it should be understood that every member of a genus can be, individually, an embodiment. Also, aspects described as a genus or selecting a member of a genus should be understood to embrace combinations of two or more members of the genus. It should also be understood that while various embodiments in the specification are presented using "comprising" language, under various circumstances, a related embodiment may also be described using "consisting of" or "consisting essentially of" language.

It will be understood that the descriptions herein are exemplary and explanatory only and are not restrictive of the invention as claimed. In this application, the use of the singular includes the plural unless specifically stated otherwise. In this application, the use of "or" means "and/or" unless stated otherwise. Furthermore, the use of the term "including", as well as other forms, such as "includes" and "included," is not limiting. Also, terms such as "element" or "component" encompass both elements and components comprising one unit and elements and components that comprise more than one subunit unless specifically stated otherwise. Also, the use of the term "portion" can include part of a moiety or the entire moiety.

Unless otherwise defined herein, scientific and technical terms used in connection with the application shall have the meanings that are commonly understood by those of ordinary skill in the art. Further, unless otherwise required by context, singular terms shall include pluralities and plural terms shall include the singular. Thus, as used in this specification and the appended claims, the singular forms "a", "an", and "the" include plural referents unless the context clearly indicates otherwise. For example, reference to "a protein" includes a plurality of proteins; reference to "a cell" includes populations of a plurality of cells.

It should also be understood that when describing a range of values, the characteristic being described could be an individual value found within the range. For example, "a pH from about pH 4 to about pH 6," could be, but is not limited to, pH 4, 4.2, 4.6, 5.1, 5.5, etc. and any value in between such values. Additionally, "a pH from about pH 4 to about pH 6," should not be construed to mean that the pH in question varies 2 pH units from pH 4 to pH 6, but rather a value may be picked from within a two pH range for the pH of the solution.

In some embodiments, when the term "about" is used, it means the recited number plus or minus 1%, 5%, 10%, 15% or more of that recited number. The actual variation intended is determinable from the context.

The section headings used herein are for organizational purposes only and are not to be construed as limiting the subject matter described. All documents, or portions of documents, cited in this application, including but not limited to patents, patent applications, articles, books, and treatises, are hereby expressly incorporated by reference in their entirety for any purpose.

The present invention provides modified apelin polypeptides that act as agonists of the APJ receptor. As used herein, an "APJ receptor agonist" refers to a molecule that is able to activate the APJ receptor, which can then affect or stimulate biochemical, cellular or physiologic processes. The APJ receptor agonist may bind to the APJ receptor. The term also can refer to a polypeptide having biological activity at least comparable to a naturally-occurring apelin peptide; however, it can also refer to a polypeptide having biological activity less than a naturally-occurring apelin peptide. The term further includes molecules that potentiate the effects of the naturally-occurring apelin peptides. The APJ receptor agonist can be an APJ ligand, which refers to a molecule that binds to the APJ receptor or forms a complex with the APJ receptor. The ligand may be, but is not necessarily, a signal triggering molecule.

In some embodiments, the modified apelin polypeptides of the invention are more stable as compared with native apelin polypeptides. For instance, in one embodiment, the modified apelin polypeptides of the invention have increased stability (e.g. proteolytic stability) relative to apelin-13 (SEQ ID NO: 4) or pyroglutamated apelin-13 (SEQ ID NO: 6). In these and other embodiments, the modified apelin polypeptides have comparable or enhanced APJ receptor agonist activity as compared with native apelin polypeptides. In certain embodiments, the modified apelin polypeptides of the invention have an agonistic activity on the heart by increasing, for example, various aspects of cardiac contractility, such as dp/dt, ejection fraction, or heart rate. The term "native apelin peptides" or "endogenous apelin peptides" includes full-length apelin preprotein having the sequence MNLRLCVQAL LLLWLSLTAV CGGSLMPLPD GNGLEDGNVR HLVQPRGSRN GPGPWQGGRR KFRRQRPRLS HKGPMPF (SEQ ID NO: 2); apelin (42-77), also referred to as Apelin-36, having the sequence LVQPRGSRNG PGPWQGGRRK FRRQRPRLSH KGPMPF (SEQ ID NO: 3); apelin (65-77), also referred to as wild-type Apelin-13, having the sequence QRPRLSHKGPMPF (SEQ ID NO: 4); apelin (61-77), also known as Apelin-17, having the sequence KFRRQRPRLS HKGPMPF (SEQ ID NO:5), and other fragments of full-length apelin. The apelin fragments are often defined as a particular range of amino acid sequences within the full-length apelin preprotein (SEQ ID NO: 2). For example, for Apelin-17, the N-terminal K is at position 61 and the C-terminal F is at position 77 relative to the full-length apelin protein (SEQ ID NO: 2). In some embodiments, the modified apelin peptides of the invention may be defined as having particular amino acid substitutions at positions corresponding to amino acids 61 to 77 in the full-length apelin sequence (SEQ ID NO: 2). By way of example, the notation Oic74 refers to an Oic residue in the modified polypeptide at a position corresponding to amino acid 74 in SEQ ID NO: 2.

In one embodiment of the invention, the modified apelin polypeptide comprises the sequence of the following formula:

$Nx^1x^2x^3x^4x^5x^6x^7x^8x^9x^{10}x^{11}x^{12}x^{13}x^{14}x^{15}x^{16}x^{17}$ (SEQ ID NO: 1), wherein:

N is an extension, conjugation linker or any moiety (e.g. an acetyl group, γ-glu or a lipid) that can improve stability relative to wild-type apelin-13 (SEQ ID NO: 4);

$x^1$ is absent, is a basic or polar amino acid residue, or comprises a portion of a conjugation linker;

$x^2$ is absent, is a nonfunctional or hydrophobic amino acid residue, or comprises a portion of a conjugation linker;

$x^3$ is absent, is basic or polar amino acid residue, or comprises a portion of a conjugation linker;

$x^4$ is absent, is a basic or polar amino acid residue, or comprises a portion of a conjugation linker;

$x^5$ is absent or is a nonfunctional, hydrophobic, or polar residue (e.g. pE, Q, Cit, L, V, G, H or P), or comprises a portion of a conjugation linker;

$x^6$ is absent or is a polar or basic residue (e.g. K or Cit, R, NMeArg, or hArg);

$x^7$ is a nonfunctional or hydrophobic residue (e.g. P, Oic, or G);

$x^8$ is a basic or polar residue (e.g. Q, Cit, R, NMeArg, or hArg);

$x^9$ is a nonfunctional or hydrophobic residue (e.g. V, I, or L preferred, NMeLeu or Cha);

$x^{10}$ is a nonfunctional, polar, or hydrophobic residue, or comprises a portion of a conjugation linker (e.g. S, F, and 4F-Phe);

$x^{11}$ is a nonfunctional, polar, basic, or hydrophobic residue, or comprises a portion of a conjugation linker;

$x^{12}$ is a nonfunctional, hydrophobic, polar, or basic residue;

$x^{13}$ is a nonfunctional or aromatic residue (e.g. G);

$x^{14}$ is a nonfunctional or hydrophilic residue (e.g. P and Oic);

$x^{15}$ is a nonfunctional, polar, or hydrophobic residue (e.g. aliphatic, aromatic, hydrophobic residues);

$x^{16}$ is a nonfunctional or a hydrophobic residue (e.g. F, 4I-Phe, 4Cl-Phe, Bip, P, Oic); and $x^{17}$ is absent or is a hydrophobic residue (e.g. aromatic residues).

The amino acid residues in the above formula can be D- or L-amino acids, α- or β-amino acids, non-canonical amino acids or D or L- or α- or β-forms of the non-canonical amino acids.

The term "amino acid" or "residue" should be understood to mean a compound containing an amino group ($NH_2$), a carboxylic acid group (COOH), and any of various side groups, that have the basic formula $NH_2CHRCOOH$, and that link together by peptide bonds to form proteins. Amino acids may, for example, be acidic, basic, aromatic, polar or derivatized. Non-standard amino acids may be referred to as "non-canonical" amino acids. Amino acids are naturally found in the α- and L-form, however, β- and D-form amino acids can also be prepared. (Araghi, R. R. et al., Amino Acids 41:733-742, 2011) In α-amino acids, the carboxylic acid group and the amino group are bonded to the same carbon center. In β-amino acids, the amino group is bonded to the β carbon which is found in most amino acids except glycine. In general, β-amino acids are rarely observed in nature relative to the dominant α-form.

A one-letter abbreviation system is frequently applied to designate the identities of the twenty "canonical" amino acid residues generally incorporated into naturally occurring peptides and proteins (Table 1). Such one-letter abbreviations are entirely interchangeable in meaning with three-letter abbreviations, or non-abbreviated amino acid names. Within the one-letter abbreviation system used herein, an upper case letter indicates an L-amino acid, and a lower case letter indicates a D-amino acid. For example, the abbreviation "R" designates L-arginine and the abbreviation "r" or "[r]" designates D-arginine.

TABLE 1

One-Letter Abbreviations for the Canonical Amino Acids (Three letter abbreviations are in parentheses.)

| | |
|---|---|
| Alanine (Ala) | A |
| Glutamine (Gln) | Q |
| Leucine (Leu) | L |
| Serine (Ser) | S |
| Arginine (Arg) | R |
| Glutamic Acid (Glu) | E |
| Lysine (Lys) | K |
| Threonine (Thr) | T |
| Asparagine (Asn) | N |
| Glycine (Gly) | G |
| Methionine (Met) | M |
| Tryptophan (Trp) | W |
| Aspartic Acid (Asp) | D |
| Histidine (His) | H |
| Phenylalanine (Phe) | F |
| Tyrosine (Tyr) | Y |
| Cysteine (Cys) | C |
| Isoleucine (Ile) | I |
| Proline (Pro) | P |
| Valine (Val) | V |

An amino acid substitution in an amino acid sequence can be designated herein with a one-letter abbreviation for the amino acid residue in a particular position, followed by the numerical amino acid position relative to a native sequence of interest, which is then followed by the one-letter symbol for the amino acid residue substituted in. For example, "T30D" symbolizes a substitution of a threonine residue by an aspartate residue at amino acid position 30, relative to the native sequence of interest.

Amino acid residues are commonly categorized according to different chemical and/or physical characteristics. The term "acidic amino acid residue" refers to amino acid residues in D- or L-form having side chains comprising acidic groups. Exemplary acidic residues include aspartic acid and glutamic acid residues. The term "alkyl amino acid residue" refers to amino acid residues in D- or L-form having $C_{1-6}$ alkyl side chains which may be linear, branched, or cyclized, including to the amino acid amine as in proline, wherein the $C_{1-6}$ alkyl is substituted by 0, 1, 2 or 3 substituents selected from $C_{1-4}$haloalkyl, halo, cyano, nitro, $—C(=O)R^b$, $—C(=O)OR^a$, $—C(=O)NR^aR^a$, $—C(=NR^a)NR^aR^a$, $—NR^aC(=NR^a)NR^aR^a$, $—OR^a$, $—OC(=O)R^b$, $—OC(=O)NR^aR^a$, $—OC_{2-6}alkylNR^aR^a$, $—OC_{2-6}alkylOR^a$, —SiR, $—S(=O)R^b$, $—S(=O)_2R^b$, $—S(=O)_2NR^aR^a$, $—NR^aR^a$, $—N(R^a)C(=O)R^b$, $—N(R^a)C(=O)OR^b$, $—N(R^a)C(=O)NR^aR^a$, $—N(R^a)C(=NR^a)NR^aR^a$, $—N(R^a)S(=O)_2R^b$, $—N(R^a)S(=O)_2NR^aR^a$, $—NR^aC_{2-6}$ $alkylNR^aR^a$ and $—NR^aC_{2-6}$ $alkylOR^a$; wherein $R^a$ is independently, at each instance, H or $R^b$; and $R^b$ is independently, at each instance $C_{1-6}$alkyl substituted by 0, 1, 2 or 3 substituents selected from halo, $C_{1-4}$ alkyl, $C_{1-3}$haloalkyl, $—OC_{1-4}alkyl$, $—NH_2$, $—NHC_{1-4}alkyl$, and $—N(C_{1-4}alkyl)C_{1-4}alkyl$; or any protonated form thereof, including alanine, valine, leucine, isoleucine, proline, serine, threonine, lysine, arginine, histidine, aspartate, glutamate, asparagine, glutamine, cysteine, methionine, hydroxyproline, cyclohexylalanine, norleucine, norvaline, 2-aminobutyric acid, but which residues do not contain an aryl or aromatic group.

The term "aromatic amino acid residue" refers to amino acid residues in D- or L-form having side chains comprising aromatic groups. Exemplary aromatic residues include tryptophan, tyrosine, 3-(1-naphthyl)alanine, histidine, or phenylalanine residues. The term "basic amino acid residue" refers to amino acid residues in D- or L-form having side chains comprising basic groups. Exemplary basic amino acid residues include histidine, lysine, homolysine, ornithine, arginine, N-methyl-arginine, ω-aminoarginine, ω-methyl-arginine, 1-methyl-histidine, 3-methyl-histidine, and homoarginine (hR) residues. The term "hydrophilic amino acid residue" or "polar amino acid residue" refers to amino acid residues in D- or L-form having side chains comprising polar groups. Exemplary hydrophilic or polar residues include cysteine, serine, threonine, histidine, lysine, asparagine, aspartate, glutamate, glutamine, and citrulline (Cit) residues. The term "hydrophobic amino acid residue" or "lipophilic amino acid residue" refers to amino acid residues in D- or L-form having sidechains comprising uncharged, aliphatic or aromatic groups. Exemplary lipophilic sidechains include phenylalanine, isoleucine, leucine, norleucine, methionine, valine, tryptophan, and tyrosine. Alanine (A) is amphiphilic—it is capable of acting as a hydrophilic, or lipophilic (i.e., hydrophobic), residue. Alanine, therefore, is included within the definition of both "lipophilic" (i.e., "hydrophobic") residue and "hydrophilic" residue. The term "nonfunctional" or "neutral" amino acid residue refers to amino acid residues in D- or L-form having side chains that lack acidic, basic, or aromatic groups. Exemplary neutral amino acid residues include methionine, glycine, alanine, valine, isoleucine, leucine, and norleucine.

The term "non-canonical" or "unnatural" amino acids refers to amino acid residues in D- or L-form that are not among the 20 canonical amino acids generally incorporated into naturally occurring proteins. Examples of non-canonical amino acids can be found in FIG. 1 and Table 2. Non-canonical amino acid residues can be incorporated into a peptide by employing known techniques of protein engineering that use recombinantly expressing cells. See, e.g., Link et al., Non-canonical amino acids in protein engineering, Current Opinion in Biotechnology, 14(6):603-609, 2003. Additional examples of non-canonical amino acids include, but are not limited to, for example, β-amino acids, homoamino acids, cyclic amino acids and amino acids with derivatized side chains. Additional examples can include (in the L-form or D-form) β-alanine, β-aminopropionic acid, piperidinic acid, aminocaprioic acid, aminoheptanoic acid, aminopimelic acid, desmosine, diaminopimelic acid, $N^{\alpha}$-ethylglycine, $N^{\alpha}$-ethylaspargine, hydroxylysine, allo-hydroxylysine, isodesmosine, allo-isoleucine, ω-methyl-arginine, $N^{\alpha}$-methylglycine, $N^{\alpha}$-methylisoleucine, $N^{\alpha}$-methylvaline, γ-carboxyglutamate, ε-N,N,N-trimethyllysine, ε-N-acetyllysine, O-phosphoserine, $N^{\alpha}$-acetylserine, $N^{\alpha}$-formylmethionine, 3-methylhistidine, 5-hydroxylysine, and other similar amino acids, and those listed in Table 2 below, and derivatized forms of any of these as described herein. Table 2 and FIG. 1 contain some exemplary non-canonical amino acid residues that may be incorporated into the modified apelin polypeptides of the invention as well as the associated abbreviations as typically used herein. However, the ordinary-skilled artisan will understand that different abbreviations and nomenclatures may be applicable to the same substance and appear interchangeably herein. Some amino acid sequences, as recited herein may include "{H}," "{H2}," or "{Hydrogen}" at the N-terminus, all of which represent an N-terminal amino group, and/or may include "-{Free Acid}" or {COOH} at the C-terminus, both of which represent a C-terminal carboxy group. Some sequences include an "Ac," "Acetyl," or "Acetyl-NH" at the N-terminus, which indicates acetylation at the N-terminus (e.g. acetate or acetamide). As used herein, the term "bromoacetyl" refers to bromoacetate or bromoacetamide.

In the event an abbreviation listed in Table 2 differs from another abbreviation for the same substance disclosed elsewhere herein, both abbreviations are understood to be applicable. The amino acids listed in Table 2 can be in the L-form or D-form, unless otherwise noted.

TABLE 2

Examples of Non-Canonical Amino Acids for Use in Peptide Sequences

| AMINO ACID | ABBREVIATIONS |
|---|---|
| 1'N-methyltryptophan | 1'NMeW |
| 1-aminocyclohexanecarboxylic acid | 1-Ach |
| 3-(1-naphthyl)alanine | 1-Nal; 1Nal |
| 2-aminobutyric acid | 2-Abu |
| 2-chloro-L-phenylalanine | 2-Cl—F |
| 3-(2-naphthyl)alanine | 2-Nal; 2Nal |
| 2-pyridinylalanine | 2Pal |
| 2-amino-3-guanidinopropanoic acid | 3G-Dpr |
| 3-pyridinylalanine | 3Pal |
| 4-amino-phenylalanine (also known as para-aminophenylalanine) | 4AmP; 4-AminoF; 4-Amino-Phe |
| 4-amidino-phenylalanine | 4AmPhe |
| 2-amino-2-(1-carbamimidoylpiperidin-4-yl)acetic acid | 4AmPig |
| 4-benzoyl-L-phenylalanine | 4-Bz—F |
| 4-trifluoromethyl-L-phenylalanine | 4CF3—F |
| 4-chloro-L-phenylalanine | 4-Cl—F |
| 4-carboxyphenylalanine | 4CO2—F |
| 4-fluoro-L-phenylalanine | 4-F—F |
| 4-guanidino proline | 4GuaPr |
| 4-methyl-L-phenylalanine | 4-Me—F |
| 4-pyridinylalanine | 4Pal |
| 4-amino-1-piperidine-4-carboxylic acid | 4Pip |
| 4-piperidinylalanine | 4PipA |
| 4-tert-butyl-L-phenylalanine | 4tBu—F |
| α-aminoadipic acid | Aad |
| aminobutyric acid | Abu |
| α-carboxy-4-aminobutyric acid | AC4Abu; γGlu |
| Acetylarginine | acetylarg |
| Acetamidomethyl | Acm |
| 1-aminocyclopentanecarboxylic acid | Acp |
| [2-(2-Amino-ethoxy)-ethoxy]-acetic acid | Aeea |
| 3-amino-6-hydroxy-2-piperidone | Ahp |
| 6-aminohexanoic acid | Ahx; εAhx |
| α-amino-isobutyric acid | Aib |
| 2-aminoindane-2-carboxylic acid | Aic |
| α-methylphenyalanine | AMeF |

TABLE 2-continued

| Examples of Non-Canonical Amino Acids for Use in Peptide Sequences | |
|---|---|
| AMINO ACID | ABBREVIATIONS |
| α-methyl-leucine | aMeLeu |
| α-methyl-lysine | aMeLys |
| α-methyl-ornithine | aMeOrn |
| α-methyl-proline | aMePro |
| α-metyl-serine | aMeS |
| Aminophenylalanine | Aminophe; Amino-Phe |
| 3-amino-2-naphthoic acid | Anc |
| 2-aminotetraline-2-carboxylic acid | Atc |
| 3-(1,2,3-triazol-4-yl)Alanine | Atz |
| 3-(1-(O-(aminoethyl)-O'-(ethylene)-ethyleneglycol450avg)-1,2,3-triazol-4-yl)Alanine | Atz(20 kDa PEG) |
| 3-(1-(O-(aminoethyl)-O'-(ethylene)-decaethyleneglycol)-1,2,3-triazol-4-yl)Alanine | Atz(amino-PEG10) |
| (S)-2-amino-3-(1-(1-hydroxy-5-oxo-9,12,15,18,21,24,27,30,33,36,39-undecaoxa-3-thia-6-azahentetracontan-41-yl)-1H-1,2,3-triazol-4-yl)propanoic acid | Atz(PEG11-((2-hydroxyethyl)thio)acetamide) |
| (S)-2-amino-3-(1-(2-oxo-6,9,12,15,18,21,24,27,30,33,36-undecaoxa-3-azaoctatriacontan-38-yl)-1H-1,2,3-triazol-4-yl)propanoic acid | Atz(PEG11-(acetamidomethyl) |
| (S)-2-amino-3-(1-(1-bromo-2-oxo-6,9,12,15,18,21,24,27,30,33,36-undecaoxa-3-azaoctatriacontan-38-yl)-1H-1,2,3-triazol-4-yl)propanoic acid | Atz(PEG11-bromoacetamide) |
| (S)-2-amino-3-(1-(1-bromo-2-oxo-6,9,12-trioxa-3-azatetradecan-14-yl)-1H-1,2,3-triazol-4-yl)propanoic acid | Atz(PEG3-bromoacetamide) |
| β-4-chloro-L-phenylalanine | B4ClF |
| β-alanine | bAla |
| β-4-chloro-L-homophenylalanine | Bh4ClF |
| β-homoarginine | BhArg |
| β-homoasparagine | BhAsn |
| β-homocyclohexylalanine | BhCha |
| β-homoglutamine | BhGln |
| β-homoleucine | BhLeu |
| β-homolysine | BhLys |
| β-homonorleucine | BhNle |
| β-homophenylalanine | BhPhe |
| β-homoproline | BhPro |
| β-homoserine | BhSer |
| β-homo Tic | BhTic |
| β-homotryptophan | BhTrp |
| 4,4'-biphenylalanine; 4-phenyl-phenylalanine; or biphenylalanine | Bip; 4Bip |
| β,β-diphenyl-alanine | BiPhA |
| β-leucine | BLeu |
| β-lysine | BLys |
| β-norleucine | BNle |
| β-ornithine | BOrn |
| β-phenylalanine | BPhe |
| L-cysteine involved in a sidechain cyclization | C1 |
| Cyclohexylalanine | Cha |
| Cyclohexylglycine | Chg |
| Citrulline | Cit |
| p-carboxyl-phenylalanine | Cpa |
| Cyclopentylglycine | CPG |
| L-Aspartate involved in a sidechain cyclization | D1 |
| 3-(1-naphthyl)-D-alanine | D-1Nal |
| 3-(2-naphthyl)-D-alanine | D-2Nal |
| 4-chloro-D-phenylalanine | D-4ClF |
| 4-Iodo-D-phenylalanine | D-4IF |
| α,γ-diaminobutyric acid | Dab |
| diaminopropionic acid | Dap |
| β-homo-D-phenylalanine | D-BhPhe |
| (R)-3-([1,1'-biphenyl]-4-yl)-2-aminopropanoic acid | D-Bip |
| 2,4-diaminobutyric acid | Dbu |
| 2-amino-2-ethylbutanoic acid | Deg |
| 3,4-dichloro-L-phenylalanine | DiCl—F |
| (R)-2-amino-2-(2,3-dihydro-1H-inden-2-yl)acetic acid | D-Igl |
| 3,4-dimethoxy-L-phenylalanine | DiMeO—F |
| 3,3-diphenylalanine | Dip |
| D-Ornithine | D-ORN |
| α,β-diaminopropionoic acid (or 2,3-diaminopropionic acid | Dpr |
| D-Norleucine ψ(CH2NH)-reduced amide bond | DrNle |
| D-Serine ψ(CH2NH)-reduced amide bond | DrSer |
| (R)-1,2,3,4-tetrahydroisoquinoline-3-carboxylic acid | D-Tic |
| (R)-1,2,3,4-tetrahydroisoquinoline-1-carboxylic acid | D-Tiq |
| L-Glutamate involved in a sidechain cyclization | E1 |
| 4-guanidino phenylalanine | Guf |

TABLE 2-continued

| Examples of Non-Canonical Amino Acids for Use in Peptide Sequences | |
|---|---|
| AMINO ACID | ABBREVIATIONS |
| homo-L-Arginine | hArg |
| Homoarginine | hArg; hR |
| Homocitrulline | hCit |
| Homoleucine | hLeu; hL |
| Homolysine | hLys; hK; homoLys |
| Homophenylalanine | hPhe; homoPhe |
| Homoglutamine | hQ |
| 1,2,3,4-tetrahydroisoquinoline-7-hydroxy-3-carboxylic acid | Hydroxyl-Tic |
| 4-hydroxyproline (or hydroxyproline) | Hyp |
| indoline-2-carboxylic acid | Idc |
| 2-indanylglycine (or indanylglycine) | IgI |
| (S)-2-amino-2-(2,3-dihydro-1H-inden-2-yl)acetic acid | Igl |
| piperidine-4-carboxylic acid | Inp |
| Iodotyrosine | I-Tyr |
| (S)-2-amino-6-(pent-4-ynamido)hexanoic acid | K(4-Pen) |
| (S)-6-((S)-2-acetamidopent-4-ynamido)-2-aminohexanoic acid | K(Ac-Pra) |
| N-ε-biotinyl-L-lysine | K(Biotin) |
| (S)-2,2',2''-(10-(2-((5-amino-5-carboxypentyl)amino)-2-oxoethyl)-1,4,7,10-tetraazacyclododecane-1,4,7-triyl)triacetic acid | K(DOTA) |
| (S)-2-amino-6-(3-(1-(1-bromo-2-oxo-6,9,12,15,18,21,24,27,30,33,36-undecaoxa-3-azaoctatriacontan-38-yl)-1H-1,2,3-triazol-4-yl)propanamido)hexanoic acid | K(ethyl-triazole-PEG11-bromoacetamide) |
| N-ε-dimethyl lysine | K(Me2) |
| Nε-(O-(aminoethyl)-O'-(2-propanoyl)-undecaethyleneglycol)-Lysine | K(NPeg11) |
| Nε-(O-(aminoethyl)-O'-(2-propanoyl)-(ethyleneglycol) 27-Lysine | K(NPeg27) |
| L-Lysine involved in a sidechain cyclization | K1 |
| 4-methyl-phenylalanine | MePhe |
| methionine oxide | Met[O] |
| methionine sulfone | Met[O]2 |
| $N^{\alpha}$-methylhomocitrulline | N a-MeHoCit |
| $N^{\alpha}$-methylornithine | N a-MeOrn; NMeOrn |
| 2-((4-chlorobenzyl)amino)acetic acid | N4ClFG |
| $N^{\alpha}$-methylleucine | Na—MeL; NMeL; NMeLeu; NMe-Leu |
| $N^{\alpha}$-[(CH2)3NHCH(NH)NH2] substituted glycine | N-Arg |
| Nε-ethyl-lysine | N-eEt-K |
| Nε-isopropyl-lysine | N-eIPr-K |
| Nε-methyl-lysine | N-eMe—K |
| N-α-(2-hydroxyethyl)-glycine | NhSerG |
| nipecotic acid | Nip |
| Nitrophenylalanine | nitrophe |
| norleucine | Nle |
| 2-((4-aminobutyl)amino)acetic acid | NLysG |
| (S)-3-(4-chlorophenyl)-2-(methylamino)propanoic acid | NMe4ClF |
| (S)-5-guanidino-2-(methylamino)pentanoic acid; $N^{\alpha}$-methylarginine | NMeArg |
| (S)-3-cyclohexyl-2-(methylamino)propanoic acid | NMeCha |
| $N^{\alpha}$-methylcitrulline | NMeCit |
| (S)-5-amino-2-(methylamino)-5-oxopentanoic acid | NMeGln |
| (S)-6-guanidino-2-(methylamino)hexanoic acid | NMehArg |
| (S)-3-(1H-imidazol-4-yl)-2-(methylamino)propanoic acid | NMeHis |
| $N^{\alpha}$-methylhomolysine | NMeHoK |
| (S)-4-methyl-2-(methylamino)pentanoic acid | NMeLeu |
| (S)-6-amino-2-(methylamino)hexanoic acid; Nα-methyllysine | NMeLys |
| (S)-2-(methylamino)hexanoic acid; $N^{\alpha}$-methylnorleucine | NMeNle |
| (S)-2-(methylamino)-3-phenylpropanoic acid; $N^{\alpha}$-methylphenylalanine | NMePhe |
| $N^{\alpha}$-methylglutamine | NMeQ |
| (S)-3-hydroxy-2-(methylamino)propanoic acid | NMeSer |
| (2S)-3-hydroxy-2-(methylamino)butanoic acid; $N^{\alpha}$-methylthreonine | NMeThr |
| (S)-3-methyl-2-(methylamino)butanoic acid; $N^{\alpha}$-methylvaline | NMeVal |
| 2-((3-aminopropyl)amino)acetic acid | NOrnG |
| 2-(piperidin-4-ylamino)acetic acid | NPipG |
| 2-(propylamino)acetic acid | NPrG |
| norvaline | Nva |
| norvaline | Nva or Nvl |
| Ornithine | O |
| (S)-octylglycine | OctylG |
| octahydroindole-2-carboxylic acid | Oic |

TABLE 2-continued

| Examples of Non-Canonical Amino Acids for Use in Peptide Sequences | |
|---|---|
| AMINO ACID | ABBREVIATIONS |
| O-methyltyrosine | Ome-Tyr |
| Ornithine | Orn |
| pyroglutamic acid | pGlu; PE; pE |
| Phenylglycine | Phg |
| pipecolic acid | Pip |
| para-iodophenylalanine (or 4-iodophenylalanine) | pI-Phe |
| Propargylglycine | Pra |
| L-phosphoserine | pS |
| ω-N-methylarginine | R(Me) |
| Arg ψΨ(CH2NH)-reduced amide bond | rArg |
| Cyclohexylalanine ψ(CH2NH)-reduced amide bond | rCha |
| homoArginineψ(CH2NH)-reduced amide bond | rhArg |
| Histidine ψ(CH2NH)-reduced amide bond | rHis |
| Lysine ψ(CH2NH)-reduced amide bond | rLys |
| Norleucine ψ(CH2NH)-reduced amide bond | rNle |
| Orn ψ(CH2NH)-reduced amide bond | rOrn |
| Phenylalanine ψ(CH2NH)-reduced amide bond | rPhe |
| Serine ψ(CH2NH)-reduced amide bond | rSer |
| Sarcosine | Sar |
| symmetrical N'-ω-dimethyl arginine | SDMA |
| 3-thienylalanine | Thi |
| thiazolidine-4-carboxylic acid | Thz |
| 1,2,3,4-tetrahydroisoquinoline | Tic |
| 1,2,3,4-tetrahydroisoquinoline-1-carboxylic acid | Tiq |
| (S)-tert-butylglycine | Tle |
| 1,2,3,4-tetrahydronorharman-3-carboxylic acid | Tpi |

The modified apelin polypeptides of the invention can be from about 10 amino acids to about 80 amino acids in length, from about 13 amino acids to about 40 amino acids in length, or from about 15 amino acids to about 25 amino acids in length. In certain embodiments, the modified apelin polypeptides are about 12 amino acids in length. In other embodiments, the modified apelin polypeptides are about 13 amino acids in length. In one particular embodiment, the modified apelin polypeptide is about 15 amino acids in length. In another particular embodiment, the modified apelin polypeptide is about 17 amino acids in length. In some embodiments, the modified apelin polypeptide is about 36 amino acids in length.

In certain embodiments, the modified apelin polypeptides of the invention have at least one non-canonical amino acid. In other embodiments, the modified apelin polypeptides have at least two, at least three, at least four, at least five, at least six, at least seven, at least eight, or at least nine non-canonical amino acids. The modified apelin polypeptides can have at least 25% of the total amino acids in the peptide as non-canonical amino acids. For instance, in some embodiments, at least 30% of the amino acids in the polypeptide are non-canonical amino acids. In one embodiment, the modified apelin polypeptides of the invention have at least 50% of the amino acids in the polypeptide as non-canonical amino acids. In another embodiment, at least 60% of the amino acids in the modified apelin polypeptide are non-canonical amino acids. In still another embodiment, at least 70% of the amino acids in the modified apelin polypeptide are non-canonical amino acids. The non-canonical amino acids can be any of those disclosed herein, including those listed in Table 2.

In some embodiments, the modified apelin polypeptides of the invention comprise the amino acid sequence:

$X_1$ $X_2$ $X_3X_4$ $X_5$ $X_6$ $X_7$ $X_8$ $X_9X_{10}GX_{11}X_{12}$ $X_{13}$ $X_{14}$ (SEQ ID NO: 717), wherein:

$X_1$ is R, E, [hArg], or absent;

$X_2$ is [r], R, E, [hArg], or absent;

$X_3$ is Q, [q], or [BLeu];

$X_4$ is [hArg], [NMeArg], R, E, or [r];

$X_5$ is P or [aMePro];

$X_6$ is R, E, [r], [hArg] or [NMeArg];

$X_7$ is L, [aMeLeu], [BLeu], [NMeLeu] or [Cha];

$X_8$ is S, [BhSer], or [NhSerG];

$X_9$ is H or Y;

$X_{10}$ is K or [NLysG];

$X_{11}$ is P, [Oic], [aMePro], or [Pip];

$X_{12}$ is [Nle], [rNle], or [pI-Phe];

$X_{13}$ is P, [BhPro], [aMePro], or [Aib]; and $X_{14}$ is F, [D-BhPhe], [4-Cl-F], [D-4ClF], or [D-Bip].

In some such embodiments, $X_7$ is [NMeLeu], $X_{12}$ is [pI-Phe], and $X_{14}$ is [D-Bip]. In related embodiments, $X_1$ is [hArg], $X_2$ is [hArg], $X_3$ is Q, $X_4$ is [hArg], and $X_5$ is P. In certain embodiments, $X_6$ and $X_7$ are, respectively, [NMeArg] and [aMeLeu], [hArg] and [BLeu], or [hArg] and [aMeLeu]. In other particular embodiments, $X_{13}$ is [BhPro], [aMePro], or [Aib] and $X_{14}$ is [D-BhPhe] or [4-Cl-F]. The modified apelin polypeptides of the invention can comprise a sequence selected from SEQ ID NOs: 8-11, 16, 17, 31, 32, 45, 53, 60, 68, 69-71, 92, 112, 114, 119, 120, 221, 228, 237, 263, 286, 287, 362, 373, 376, 379, 382, 388, 412, 416, 460, 468, 482, 483, 485, 491, 498, 499, 500, 502, 505, 514, 519, 526, 531, 534, 544, 552, 554, 560, and 571. In some embodiments, the modified apelin polypeptide comprises the amino acid sequence selected from SEQ ID NOs: 19, 20, 22-24, 29, 30, 33, 34, 37, 46, 47, 50-52, 55, 56, 97-105, 107, 109, 111, 115, 117, 118, 127, 150, 154, 156, 157, 176-181, 183-185, 211-232, 236, 241, 242, 261-267, 270, 274, 275, 278-281, 284, 349, 540, and 698.

The modified apelin polypeptides of the invention may be acetylated at the N-terminus. For instance, in one embodiment, the modified apelin polypeptides comprise the amino acid sequence:

Ac—$X_1$ $X_2$ $X_3$ $X_4X_5$ $X_6X_7$ $X_8X_9$ $X_{10}X_{11}X_{12}$ $X_{13}$ $X_{14}$ $X_{15}$ $X_{16}X_{17}$ (SEQ ID NO: 718), wherein: $X_1$ is O or [BhLys]; $X_2$ is F, [BhPhe] or [Bphe]; $X_3$ is [hArg], [NmeArg] or [BhArg]; $X_4$ is [hArg], [NmeArg] or [BhArg]; $X_5$ is Q, [BhGln], [BhAsn] or [BhLeu]; $X_6$ is [hArg], [NmeArg] or [BhArg]; $X_7$ Is P, [Sar], [Aib], [BhPro] or [Pip]; $X_8$ is [hArg], [NmeArg] or [BhArg]; $X_9$ is [Cha] or [BhLeu]; $X_{10}$ is S, [BhSer], [Sar] or [bAla]; $X_{11}$ is H, [NmeVal] or [bAla]; $X_{12}$ is K, [NmeLys], [BhLys], [Blys] or [bAla]; $X_{13}$ is G, [Sar], [Aib] or [bAla]; $X_{14}$ is [Oic], [Aib], [Sar], [bAla], [BhPro] or [Pip]; $X_{15}$ is [Nle] or [bAla]; $X_{16}$ is P, [Sar], [Aib], [BhPro], [bAla], [Pip], [D-1Nal] or [D-2Nal]; and $X_{17}$ is [4-Cl-F], [Bh-Phe] or [Bphe]. In such embodiments, the modified apelin polypeptide may comprise an amino acid sequence of any one of the peptides listed in Table 3 below.

TABLE 3

Exemplary Modified ApelinPolypeptides

| SEQ ID NO: | SEQUENCE |
|---|---|
| 668 | OF[hArg][hArg]Q[hArg]P[NMeArg][Cha]SHKG[Oic][Nle][1Nal] |
| 669 | OF[NMeArg][hArg]Q[hArg]P[hArg][Cha]SHKG[Oic][Nle]P[4-Cl-F] |
| 670 | OF[hArg][NMeArg]Q[hArg]P[hArg][Cha]SHKG[Oic][Nle]P[4-Cl-F] |
| 671 | OF[hArg][hArg]Q[NMeArg]P[hArg][Cha]SHKG[Oic][Nle]P[4-Cl-F] |
| 672 | OF[hArg][hArg]Q[NMeArg]P[NMeArg][Cha]SHKG[Oic][Nle]P[4-Cl-F] |
| 673 | OF[hArg][NMeArg]Q[NMeArg]P[NMeArg][Cha]SHKG[Oic][Nle]P[4-Cl-F] |
| 674 | [hArg]Q[hArg]P[NMeArg][Cha]SHKG[Oic][Nle]P[4-Cl-F] |
| 675 | Q[hArg]P[NMeArg][Cha]SHKG[Oic][Nle]P[4-Cl-F] |
| 676 | OF[hArg][hArg]Q[hArg][Sar][hArg][Cha]SHKG[Oic][Nle]P[4-Cl-F] |
| 677 | OF[hArg][hArg]Q[hArg][Aib][hArg][Cha]SHKG[Oic][Nle]P[4-Cl-F] |
| 678 | OF[hArg][hArg]Q[hArg]P[hArg][Cha][Sar]HKG[Oic][Nle]P[4-Cl-F] |
| 679 | OF[hArg][hArg]Q[hArg]P[hArg][Cha]S[NMeVal]KG[Oic][Nle]P[4-Cl-F] |
| 680 | OF[hArg][hArg]Q[hArg]P[hArg][Cha]SHK[Sar][Oic][Nle]P[4-Cl-F] |
| 681 | OF[hArg][hArg]Q[hArg]P[hArg][Cha]SHK[Aib][Oic][Nle]P[4-Cl-F] |
| 682 | OF[hArg][hArg]Q[hArg]P[hArg][Cha]SHKG[Aib][Nle]P[4-Cl-F] |
| 683 | OF[hArg][hArg]Q[hArg]P[hArg][Cha]SHKG[Sar][Nle]P[4-Cl-F] |
| 684 | OF[hArg][hArg]Q[hArg]P[hArg][Cha]SHKG[Oic][Nle][Sar][4-Cl-F] |
| 685 | OF[hArg][hArg]Q[hArg]P[hArg][Cha]SHKG[Oic][Nle][Aib][4-Cl-F] |
| 686 | O[BhPhe][hArg][hArg]Q[hArg]P[hArg][Cha]SHKG[Oic][Nle]P[4-Cl-F] |
| 687 | O[BPhe][hArg][hArg]Q[hArg]P[hArg][Cha]SHKG[Oic][Nle]P[4-Cl-F] |
| 688 | OF[BhArg][hArg]Q[hArg]P[hArg][Cha]SHKG[Oic][Nle]P[4]F] |
| 689 | OF[hArg][BhArg]Q[hArg]P[hArg][Cha]SHKG[Oic][Nle]P[4-Cl-F] |
| 690 | OF[hArg][hArg][BhGln][hArg]P[hArg][Cha]SHKG[Oic][Nle]P[4-Cl-F] |
| 691 | OF[hArg][hArg][BhAsn][hArg]P[hArg][Cha]SHKG[Oic][Nle]P[4-Cl-F] |

TABLE 3-continued

Exemplary Modified ApelinPolypeptides

| SEQ ID NO: | SEQUENCE |
|---|---|
| 692 | OF[hArg][hArg][BhLeu][hArg]P[hArg][Cha]SHKG[Oic][Nle]P[4-Cl-F] |
| 693 | OF[hArg][hArg]Q[BhArg]P[hArg][Cha]SHKG[Oic][Nle]P[4-Cl-F] |
| 694 | OF[hArg][hArg]Q[hArg][BhPro][hArg][Cha]SHKG[Oic][Nle]P[4-Cl-F] |
| 695 | OF[hArg][hArg]Q[hArg][Pip][hArg][Cha]SHKG[Oic][Nle]P[4-Cl-F] |
| 696 | OF[hArg][hArg]Q[hArg]P[BhArg][Cha]SHKG[Oic][Nle]P[4-Cl-F] |
| 697 | OF[hArg][hArg]Q[hArg]P[hArg][BhLeu]SHKG[Oic][Nle]P[4-Cl-F] |
| 698 | OF[hArg][hArg]Q[hArg]P[hArg][Cha][BhSer]HKG[Oic][Nle]P[4-Cl-F] |
| 699 | OF[hArg][hArg]Q[hArg]P[hArg][Cha][bAla]HKG[Oic][Nle]P[4-Cl-F] |
| 700 | OF[hArg][hArg]Q[hArg]P[hArg][Cha]S[bAla]KG[Oic][Nle]P[4-Cl-F] |
| 701 | OF[hArg][hArg]Q[hArg]P[hArg][Cha]SH[BhLys]G[Oic][Nle]P[4-Cl-F] |
| 702 | OF[hArg][hArg]Q[hArg]P[hArg][Cha]SH[BLys]G[Oic][Nle]P[4-Cl-F] |
| 703 | OF[hArg][hArg]Q[hArg]P[hArg][Cha]SH[bAla]G[Oic][Nle]P[4-Cl-F] |
| 704 | OF[hArg][hArg]Q[hArg]P[hArg][Cha]SHK[bAla][Oic][Nle]P[4-Cl-F] |
| 705 | OF[hArg][hArg]Q[hArg]P[hArg][Cha]SHKG[bAla][Nle]P[4-Cl-F] |
| 706 | OF[hArg][hArg]Q[hArg]P[hArg][Cha]SHKG[BhPro][Nle]P[4-Cl-F] |
| 707 | OF[hArg][hArg]Q[hArg]P[hArg][Cha]SHKG[Pip][Nle]P[4-Cl-F] |
| 708 | OF[hArg][hArg]Q[hArg]P[hArg][Cha]SHKG[Oic][bAla]P[4-Cl-F] |
| 709 | OF[hArg][hArg]Q[hArg]P[hArg][Cha]SHKG[Oic][Nle][BhPro][4-Cl-F] |
| 710 | OF[hArg][hArg]Q[hArg]P[hArg][Cha]SHKG[Oic][Nle][bAla][4-Cl-F] |
| 711 | OF[hArg][hArg]Q[hArg]P[hArg][Cha]SHKG[Oic][Nle][Pip][4-Cl-F] |
| 712 | OF[hArg][hArg]Q[hArg]P[hArg][Cha]SHKG[Oic][Nle][D-1Nal] |
| 713 | OF[hArg][hArg]Q[hArg]P[hArg][Cha]SHKG[Oic][Nle][D-2Nal] |
| 714 | OF[hArg][hArg]Q[hArg]P[hArg][Cha]SHKG[Oic][Nle]P[4-Cl-F] |

In other embodiments, acetylated modified apelin polypeptides of the invention comprise the amino acid sequence: [z] $X_1$ $X_2$ $X_3X_4$ $X_5$ $X_6$ $X_7$SH$X_8$G[Oic] $X_9$ $X_{10}$ $X_{11}$ (SEQ ID NO: 719), wherein: z is acetyl or absent; $X_1$ is acetyl, [r] or [hArg]; $X_2$ is [r], R or [hArg]; $X_3$ is Q or [q]; $X_4$ is [hArg], R or [r]; $X_5$ is P or [Oic]; $X_6$ is[r], [hArg] or [NMeArg]; $X_7$ is [NMeLeu] or [Cha]; $X_8$ is K or [NLysG]; $X_9$ is [pl-Phe] or [Nle]; $X_{10}$ is P or [D-1Nal] or [Pip]; and $X_{11}$ is a D-amino acid, a R-amino acid, a non-canonical amino acid or the D- or β-form of the non-canonical amino acid. In such embodiments, $X_{11}$ is [D-Bip], [4-CL-F], [D-4CLF], [TIC], [f] or is absent. Exemplary modified apelin polypeptides, including acetylated modified apelin polypeptides, are listed in Table 4 below. In certain embodiments, the modified apelin polypeptide may comprise an amino acid sequence of any one of the peptides listed in Table 4 below.

TABLE 4

AdditionalExemplary Modified ApelinPolypeptides

| SEQ ID NO: | SEQUENCE |
|---|---|
| 7 | RQRP[r][NMeLeu]SHKG[Oic][plPhe]P[D-Bip] |
| 8 | QrP[hArg][aMeLeu]SHKGP[Nle]P[4-Cl-F]{COOH} |
| 9 | QR[aMePro][hArg][aMeLeu]SHKGP[Nle]P[4-Cl-F]{COOH} |
| 10 | Q[NMehArg]P[NMeArg][aMeLeu]SHKGP[Nle]P[4-Cl-F]{COOH} |
| 11 | QRP[NMeArg][Cha]SHKG[Oic][Nle][Aib][4-Cl-F]{COOH} |
| 12 | {H2}KFRRQRPRLSHKGPMP{COOH} |
| 13 | {H2}CMPLHSRVPFP{COOH} |
| 14 | {H2}KLRKHN[Abu]LQRR[Abu]MPLHSRVPFP{COOH} |
| 15 | {H2}KLRKHNCLQRRCMPLHSRVPFP{COOH} |
| 16 | Acetyl-[hArg][r]Q[hArg]P[r][NMeLeu]SHKG[Oic][pI-Phe]P[D-Bip] {COOH} |
| 17 | Acetyl-RQRP[hArg][Cha]SHKG[Oic][Nle]P[4-Cl-F]{COOH} |
| 18 | Acetyl-[r][hArg]Q[hArg]P[r][NMeLeu]SHKG[Oic][p]-Phe]P[D-Bip] {COOH} |
| 19 | Acetyl-[hArg][hArg][q][hArg]P[r][NMeLeu]SHKG[Oic][pI-Phe]P[D-Bip] {COOH} |
| 20 | Acetyl-[hArg][hArg]Q[r]P[r][NMeLeu]SHKG[Oic][pI-Phe]P[D-Bip] {COOH} |
| 21 | Acetyl-[hArg][hArg]Q[hArg][Oic][r][NMeLeu]SHKG[Oic][pI-Phe]P[D-Bip] {COOH} |
| 22 | Acetyl-[hArg][hArg]Q[r]P[NMeArg][Cha]SHKG[Oic][pI-Phe]P[D-Bip] {COOH} |
| 23 | Acetyl-[hArg]Q[r]P[NMeArg][Cha]SHKG[Oic][Nle]P[4-Cl-F]{COOH} |
| 24 | Acetyl-[hArg]Q[r]P[NMeArg][Cha] SHKG[Oic][Nle]P[D-4ClF]{COOH} |
| 25 | Acetyl-[hArg]Q[r]P[NMeArg][Cha] SHKG[Oic][Nle][D-1Nal]{COOH} |
| 26 | Acetyl-Q[r]P[NMeArg][Cha]SHKG[Oic][[Nle]P[Tic]{COOH} |
| 27 | Acetyl-[q][hArg]P[NMeArg][Cha]SHKG[Oic][Nle]P[f]{COOH} |
| 28 | Acetyl-[hArg][q][hArg]P[NMeArg][Cha]SHKG[Oic][Nle]P[f]{COOH} |
| 29 | Acetyl-OF[hArg][hArg][BLeu][hArg]P[hArg][Cha]SHKG[Oic][Nle]P[4-Cl-F]{COOH} |
| 30 | Acetyl-OF[hArg][hArg]Q[hArg]P[hArg][BLeu]SHKG[Oic][Nle]P[4-Cl-F] {COOH} |
| 31 | {Acetyl}OF[hArg][hArg]Q[hArg]P[hArg][Cha][[NhSerG]HKG[Oic][Nle]P[4-Cl-F]{COOH} |
| 32 | {Acetyl}OF[hArg][hArg]Q[hArg]P[hArg][Cha]SH[NLysG]G[Oic][Nle]P[4-Cl-F]{COOH} |
| 33 | {Acetyl}OF[hArg][hArg]Q[hArg][aMePro][hArg][Cha]SHKG[Oic][Nle]P[4-Cl-F]{COOH} |

TABLE 4-continued

| Additional Exemplary Modified Apelin Polypeptides | |
|---|---|
| SEQ ID NO: | SEQUENCE |
| 34 | {Acetyl}OF[hArg][hArg]Q[hArg]P[hArg][aMeLeu]SHKG[Oic][Nle]P[4-Cl-F]{COOH} |
| 35 | {Acetyl}OF[hArg][hArg]Q[hArg]P[hArg][Cha][aMeS]HKG[Oic][Nle]P[4-Cl-F]{COOH} |
| 36 | {Acetyl}OF[hArg][hArg]Q[hArg]P[hArg][Cha]SH[aMeOrn]G[Oic][Nle]P[4-Cl-F]{COOH} |
| 37 | {Acetyl}OF[hArg][hArg]Q[hArg]P[hArg][Cha]SHKG[Oic][Nle][aMePro][4-Cl-F]{COOH} |
| 38 | {Acetyl}OF[hArg][hArg]Q[rhArg]P[hArg][Cha]SHKG[Oic][Nle]P[4-Cl-F]{COOH} |
| 39 | {Acetyl}OF[hArg][hArg]Q[hArg]P[rhArg][Cha]SHKG[Oic][Nle]P[4-Cl-F]{COOH} |
| 40 | {Acetyl}OF[hArg][hArg]Q[hArg]P[hArg][Cha]S[rHis]KG[Oic][Nle]P[4-Cl-FK{COOH} |
| 41 | {Acetyl}OF[hArg][hArg]Q[hArg]P[hArg][Cha]SH[rLys]G[Oic][Nle]P[4-Cl-F]{COOH} |
| 42 | {Acetyl}OF[hArg][hArg]Q[hArg]P[hArg][rCha]SHKG[Oic][Nle]P[4-Cl-F]{COOH} |
| 43 | {Acetyl}OF[hArg][hArg]Q[hArg]P[hArg][Cha][rSer]HKG[Oic][[Nle]P[4-Cl-F]{COOH} |
| 44 | {Acetyl}OF[hArg][hArg]Q[hArg]P[hArg][Cha][DrSer]HKG[Oic][Nle]P[4-Cl-F]{COOH} |
| 45 | {Acetyl}OF[hArg][hArg]Q[hArg]P[hArg][Cha]SHKG[Oic][Nle]P[4-Cl-F]{COOH} |
| 46 | {Acetyl-NH}OF[hArg][hArg]QRP[hArg][Cha]SHKGP[pI-Phe]P[D-Bip]{COOH} |
| 47 | {Acetyl-NH}OF[hArg][hArg]QRP[hArg][NMeLeu]SHKG[Oic][p]-Phe]P[D-Bip]{COOH} |
| 48 | {Acetyl-NH}OF[hArg][hArg]QRP[hArg][Cha]SHKGP[Nle][4-Cl-F]{COOH} |
| 49 | {Acetyl-NH}OF[hArg][hArg]QRP[hArg][Cha]SHKGP[Nle][2-Nal]{COOH} |
| 50 | {Acetyl-NH}rQ[hArg]Pr[NMeLeu]SHKG[Oic][pI-Phe]P[D-Bip]{COOH} |
| 51 | {Acetyl-NH}RQRP[hArg][NMeLeu]SHKG[Oic][pI-Phe]P[D-Bip]{COOH} |
| 52 | {Acetyl-NH}rQRP[hArg][NMeLeu]SHKG[Oic][pI-Phe]P[D-Bip]{COOH} |
| 53 | {Acetyl-NH}Q[hArg]Pr[NMeLeu]SHKG[Oic][p]-Phe]P[D-Bip]{COOH} |
| 54 | {Acetyl-NH}QrP[NMeArg][Cha]SHKG[Oic][Nle][D-1Nal]{COOH} |
| 55 | {Acetyl-NH}q[hArg]P[NMeArg][Cha]SHKG[Oic][Nle]P[D-4ClF]{COOH} |
| 56 | {Acetyl-NH}[hArg][hArg]Q[hArg]P[NMeArg][Cha]SHKG[Oic][Nle]P[4-Cl-F]{COOH} |
| 57 | {Acetyl-NH}OF[hArg][hArg]Q[hArg]P[NMeArg][Cha]SHKG[Oic][Nle][4-Cl-F]{COOH} |
| 58 | {Acetyl-NH}OF[hArg][hArg]Q[hArg][Oic]r[Cha]SHKG[Oic][Nle][4-Cl-F]{COOH} |
| 59 | {Acetyl-NH}OF[hArg][hArg]Q[hArg]Pr[NMeLeu]SHKG[Oic][Nle][4-Cl-F]{COOH} |
| 60 | {Acetyl-NH} [hArg] Q [[hArg] P [NMeArg] [[Cha] S H K G [[Oic] [[Nle] P [4-Cl-F]{COOH} |
| 61 | {Acetyl-NH} Q [[hArg] P [NMeArg] [[Cha] S H K G [[Oic ][[Nle] P [4-Cl-F]{COOH} |

TABLE 4-continued

AdditionalExemplary Modified ApelinPolypeptides

| SEQ ID NO: | SEQUENCE |
|---|---|
| 62 | {Acetyl-NH} R Q R P R L S H K G P [Nle] P [D-Bip] {COOH} |
| 63 | {Acetyl-NH} R Q R P R [Cha] S H K G P [Nle] P [4-Cl-F] {COOH} |
| 64 | {Acetyl-NH} R Q R P R [NMeLeu] S H K G P [Nle] P [4-Cl-F] {COOH} |
| 65 | {Acetyl-NH} R Q R P [NMeArg] L S H K G P [Nle] P [4-Cl-F] {COOH} |
| 66 | {Acetyl-NH} R Q R P [NMeArg] [[Cha] S H K G P [Nle] P [4-Cl-F] {COOH} |
| 67 | {Acetyl-NH} R Q R P [NMeArg] [[NMeLeu] S H K G P [Nle] P [4-Cl-F] {COOH} |
| 68 | {Acetyl-NH} Q R P [NMeArg] L S H K G P [Nle] P [4-Cl-F] {COOH} |
| 69 | {Acetyl-NH} Q R [aMePro] [[hArg] [[aMeLeu] S H K G P [Nle] P [4-Cl-F] {COOH} |
| 70 | {Acetyl-NH} Q r P [hArg] [[aMeLeu] S H K G P [Nle] P [4-Cl-F] {COOH} |
| 71 | {Acetyl-NH} Q [[hArg] P [NMeArg] [[aMeLeu] S H K G P [Nle] P [4-Cl-F] {COOH} |
| 72 | {Acetyl-NH} Q R [NMeArg] L S H K G P [Nle] P [4-Cl-F] {COOH} |
| 73 | {Acetyl-NH} Q R [NMehArg] L S H K G P [Nle] P [4-Cl-F] {COOH} |
| 74 | {Acetyl-NH} Q [[hArg] [[NMehArg] L S H K G P [Nle] P [4-Cl-F] {COOH} |
| 75 | {Acetyl-NH} E r Q [[hArg] P r [[NMeLeu] S H K G [[Oic] [[pI-Phe ]P [D-Bip] {COOH} |
| 76 | {Acetyl-NH} [hArg] E Q [[hArg] P r [[NMeLeu] S H K G [[Oic] [[pI-Phe] P [D-Bip]{COOH} |
| 77 | {Acetyl-NH} [hArg] r QEPr [[NMeLeu] S H K G [[Oic] [[pI-Phe] P [D-Bip] {COOH} |
| 78 | {Acetyl-NH} [hArg] r Q [[hArg] E r [[NMeLeu] S H K G[[Oic] [[pI-Phe] P [D-Bip]{COOH} |
| 79 | {Acetyl-NH} [hArg] r Q [[hArg] P E [[NMeLeu] S H K G[[Oic] [[p]-Phe] P [D-Bip]{COOH} |
| 80 | {Acetyl-NH} [hArg] r Q [[hArg] P r E S H K G [[Oic] [[pI-Phe] P [D-Bip] {COOH} |
| 81 | {Acetyl-NH} [hArg] r Q [[hArg] P r [[NMeLeu] E H K G [[Oic] [[pI-Phe] P [D-Bip]{COOH} |
| 82 | {Acetyl-NH} [hArg] r Q [[hArg] P r [[NMeLeu] S E K G [[Oic] [[pI-Phe] P [D-Bip]{COOH} |
| 83 | {Acetyl-NH} [hArg] r Q [[hArg] P r [[NMeLeu] S H E G[[Oic] [[pI-Phe] P [D-Bip]{COOH} |
| 84 | {Acetyl-NH} [hArg] r Q [[hArg] P r [[NMeLeu] S H K E [[Oic] [[pI-Phe] P [D-Bip]{COOH} |
| 85 | {Acetyl-NH} [hArg] r Q [[hArg] P r [[NMeLeu] S H K G E [[pI-Phe] P [D-Bip] {COOH} |
| 86 | {Acetyl-NH} [hArg] r Q [[hArg] P r [[NMeLeu] S H K G[[Oic] E P [D-Bip] {COOH} |
| 87 | {Acetyl-NH} [hArg] r Q [[hArg] P r [[NMeLeu] S H K G[[Oic] [[pI-Phe] E [[D-Bip] {COOH} |
| 88 | {Acetyl-NH} [AC4Abu] [[Acea] [[Aeea] Q R P [NMeArg] L S H K G P [Nle] P [4-Cl-F] {COOH} |
| 89 | {Acetyl-NH} S D F Y K R L I N K A K [[Aeea] [[ Aeea] Q R P [NMeArg] L S H K G P [Nle] P [4-Cl-F] {COOH} |

TABLE 4-continued

Additional Exemplary Modified Apelin Polypeptides

| SEQ ID NO: | SEQUENCE |
|---|---|
| 90 | {Acetyl-NH} R L I E D I C L P R W G C L W E D D [[Acea] [[Acea] Q R P [NMeArg] L S H K G P [Nle] P [4-Cl-F] {COOH} |
| 91 | {Acetyl-NH} R L I E D I C L P R W G C L W [[Aeea] [[Aeea] Q R P [NMeArg] L S H K G P [Nle] P [4-Cl-F] {COOH} |
| 92 | {Acetyl-NH} Q R P [NMeArg] [[Cha] S H K G[[Oic] [[Nle] [[Aib] [[4-Cl-F] {COOH} |
| 93 | {Acetyl-NH} q R P [NMeArg] [[Cha] S H K G [[aMePro] [[Nle] [[Aib] [[4-Cl-F] {COOH} |
| 94 | {Acetyl-NH} S D F Y K R L I N K A K [[Aeea] [[Aeea] [[hArg] r Q [[hArg] Pr [NMeLeu] S H K G [[Oic] [[pI-Phe] P [D-Bip] {COOH} |
| 95 | {Acetyl-NH} Q [[NMehArg] P [NMeArg] [[aMeLeu] S H K G P [Nle] P [4-Cl-F] {COOH} |

In some embodiments of the invention, the modified apelin polypeptides comprise the amino acid sequence: [z] $X_1$ $X_2$[hArg][hArg]$X_3X_4X_5X_6X_7$ $X_8X_9$ $X_{10}$G[Oic][Nle] $X_{11}$ [4-Cl-F](SEQ ID NO:720), wherein: z is acetyl, $X_1$ is o or O; $X_2$ is f or F; $X_3$ is Q or [BLeu]; $X_4$ is [hArg] or [rhArg]; $X_5$ is P or [aMePro]; $X_6$ is [hArg] or [rhArg]; $X_7$ is [aMeLeu], [rCha], [BLeu], or [Cha]; $X_8$ is [NhSerG], [aMeS], [rSer], [DrSer], or S; $X_9$ is H or [rHis]; $X_{10}$ is K, [NLysG], [rLys], or [aMeOrn]; and $X_{11}$ is P or [aMePro]. In these and other embodiments, the modified apelin polypeptide comprises an amino acid sequence selected from SEQ ID NOs: 29-44.

The present invention also includes variants of the modified apelin polypeptides described herein. Variants of the disclosed apelin polypeptides may be generated by making amino acid additions or insertions, amino acid deletions, amino acid substitutions, and/or chemical derivatives of amino acid residues within the apelin polypeptide sequence. Desired amino acid substitutions (whether conservative or non-conservative) can be determined by those skilled in the art in accordance with guidance provided herein for increasing stability, while maintaining or enhancing potency of the apelin polypeptides. In certain embodiments, conservative amino acid substitutions can encompass non-naturally occurring amino acid residues which are typically incorporated by chemical peptide synthesis rather than by synthesis in biological systems.

Conservative modifications can produce peptides having functional, physical, and chemical characteristics similar to those of the peptide from which such modifications are made. In contrast, substantial modifications in the functional and/or chemical characteristics of peptides may be accomplished by selecting substitutions in the amino acid sequence that differ significantly in their effect on maintaining (a) the structure of the molecular backbone in the region of the substitution, for example, as an α-helical conformation, (b) the charge or hydrophobicity of the molecule at the target site, or (c) the size of the molecule. For example, a "conservative amino acid substitution" may involve a substitution of a native amino acid residue with a non-native residue such that there is little or no effect on the polarity or charge of the amino acid residue at that position. Furthermore, any native residue in the polypeptide may also be substituted with alanine, as has been previously described for "alanine scanning mutagenesis" (see, for example, MacLennan et al., Acta Physiol. Scand. Suppl., 643:55-67, 1998; Sasaki et al., Adv. Biophys. 35:1-24, 1998, which discuss alanine scanning mutagenesis).

Naturally occurring residues may be divided into classes based on common side chain properties:

hydrophobic: norleucine (Nor or Nle), Met, Ala, Val, Leu, Ile;

neutral hydrophilic: Cys, Ser, Thr, Asn, Gln;

acidic: Asp, Glu;

basic: His, Lys, Arg;

residues that influence chain orientation: Gly, Pro; and aromatic: Trp, Tyr, Phe.

Conservative amino acid substitutions may involve exchange of a member of one of these classes with another member of the same class. Non-conservative substitutions may involve the exchange of a member of one of these classes for a member from another class.

In making such changes, according to certain embodiments, the hydropathic index of amino acids may be considered. Each amino acid has been assigned a hydropathic index on the basis of its hydrophobicity and charge characteristics. They are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic amino acid index in conferring interactive biological function on a protein is understood in the art (see, for example, Kyte et al., J. Mol. Biol. 157:105-131, 1982). It is known that certain amino acids may be substituted for other amino acids having a similar hydropathic index or score and still retain a similar biological activity. In making changes based upon the hydropathic index, in certain embodiments, the substitution of amino acids whose hydropathic indices are within ±2 is included. In certain embodiments, those that are within ±1 are included, and in certain embodiments, those within ±0.5 are included Substitution of like amino acids can be made effectively on the basis of hydrophilicity. In certain embodiments, the greatest local average hydrophilicity of a protein, as governed by the hydrophilicity of its adjacent amino acids, correlates with its immunogenicity and antigenicity, i.e., with a biological property of the protein.

The following hydrophilicity values have been assigned to these amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). In making changes based upon similar hydrophilicity values, in certain embodiments, the substitution of amino acids whose hydrophilicity values are within ±2 is included, in certain embodiments, those that are within ±1 are included, and in certain embodiments, those within ±0.5 are included.

Examples of conservative substitutions include the substitution of one non-polar (hydrophobic) amino acid residue such as isoleucine, valine, leucine norleucine, alanine, or methionine for another non-polar residue, the substitution of one polar (hydrophilic) amino acid residue for another polar residue, such as between arginine and lysine, between glutamine and asparagine, between glycine and serine, the substitution of one basic amino acid residue such as lysine, arginine or histidine for another basic residue, or the substitution of one acidic residue, such as aspartic acid or glutamic acid for another acidic residue. The phrase "conservative amino acid substitution" also includes the use of a chemically derivatized residue in place of a non-derivatized residue, provided that such polypeptide displays the requisite bioactivity. Other exemplary amino acid substitutions that can be used in generating variants of the modified apelin polypeptides disclosed herein are set forth in Table 5 below.

TABLE 5

Some Useful Amino Acid Substitutions

| ORIGINAL RESIDUES | EXEMPLARY SUBSTITUTIONS |
|---|---|
| Ala | Val, Leu, Ile, Gly |
| Arg | Lys, Gln, Asn, His |
| Asn | Gln |
| Asp | Glu |
| Cys | Ser, Ala |
| Gln | Asn |
| Glu | Asp |
| Gly | Pro, Ala |
| His | Asn, Gln, Lys, Arg |
| Ile | Leu, Val, Met, Ala, Phe, Norleucine |
| Leu | Norleucine, Ile, Val, Met, Ala, Phe |
| Lys | Arg, 1,4-Diamino-butyric Acid, Gln, Asn, His |
| Met | Leu, Phe, Ile |
| Phe | Leu, Val, Ile, Ala, Tyr |
| Pro | Ala |
| Ser | Thr, Ala, Cys |
| Thr | Ser |
| Trp | Tyr, Phe |
| Tyr | Trp, Phe, Thr, Ser |
| Val | Ile, Met, Leu, Phe, Ala, Norleucine |

Variants of the modified apelin polypeptides described herein can also be generated by derivatizing amino acids within the polypeptide sequence. The terms "derivatizing" and "derivative" or "derivatized" should be understood to mean processes and resulting compounds respectively in which a portion of the parent molecule has been modified chemically. Examples can include: (1) a compound having a cyclic portion; for example, cross-linking between residues within the compound; (2) a compound cross-linked or having a cross-linking site; for example, the compound has a cysteinyl residue and thus forms cross-linked dimers; (3) one or more peptidyl linkages are replaced by a non-peptidyl linkage; (4) an N-terminus is modified with agents capable of reacting with the amino group; (5) the C-terminus can be replaced with an amide or ester; and (6) compounds in which individual amino acid moieties are modified through treatment with agents capable of reacting with selected side chains or terminal residues.

Figure 3:
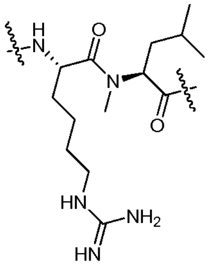
FIG. 3. Strategies to stabilize peptide agonists against metabolism using backbone modifications.
Figure 3:
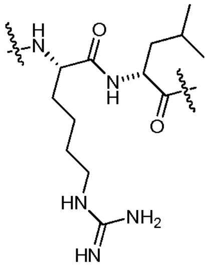
Figure 3:
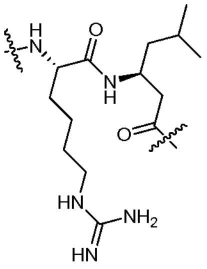
Figure 3:
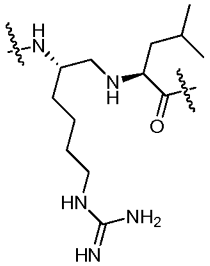
Figure 3:
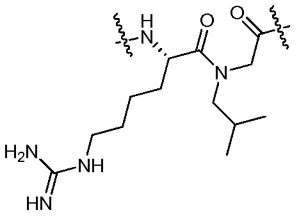
Figure 3:
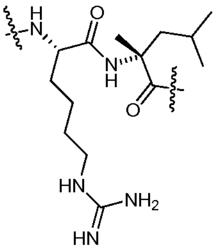
Figure 3:
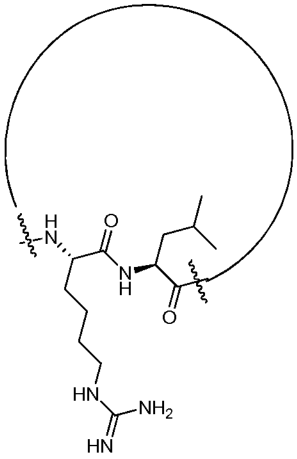
Figure 4A:
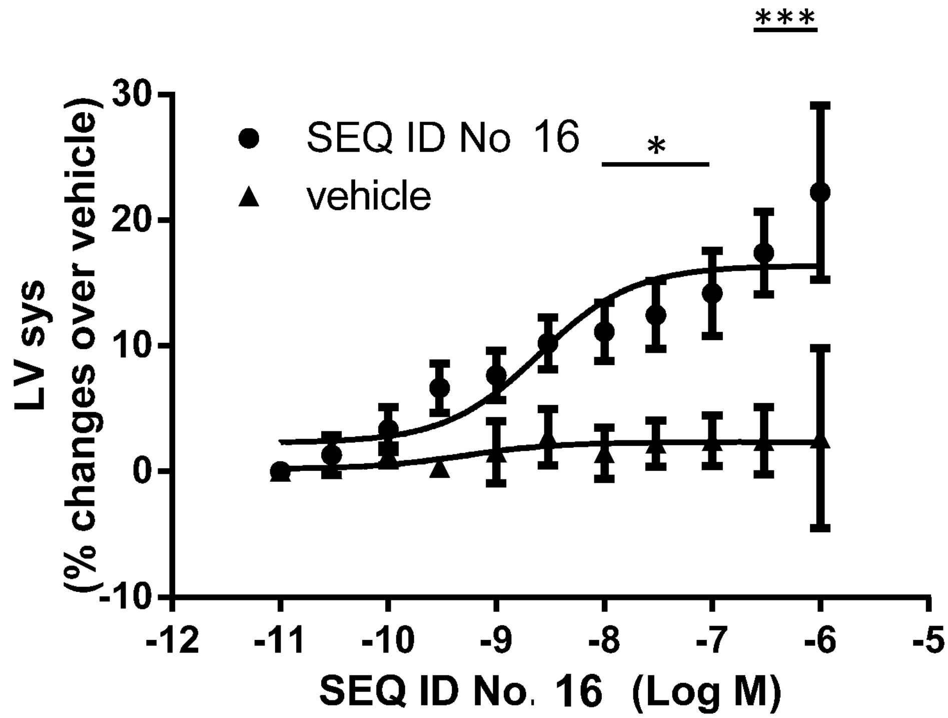
FIGS. 4A-4D show inotropic effects of apelin polypeptide SEQ ID NO: 16 (N=8) as compared with vehicle (N=6) in isolated perfused rat hearts.
Figure 4B:
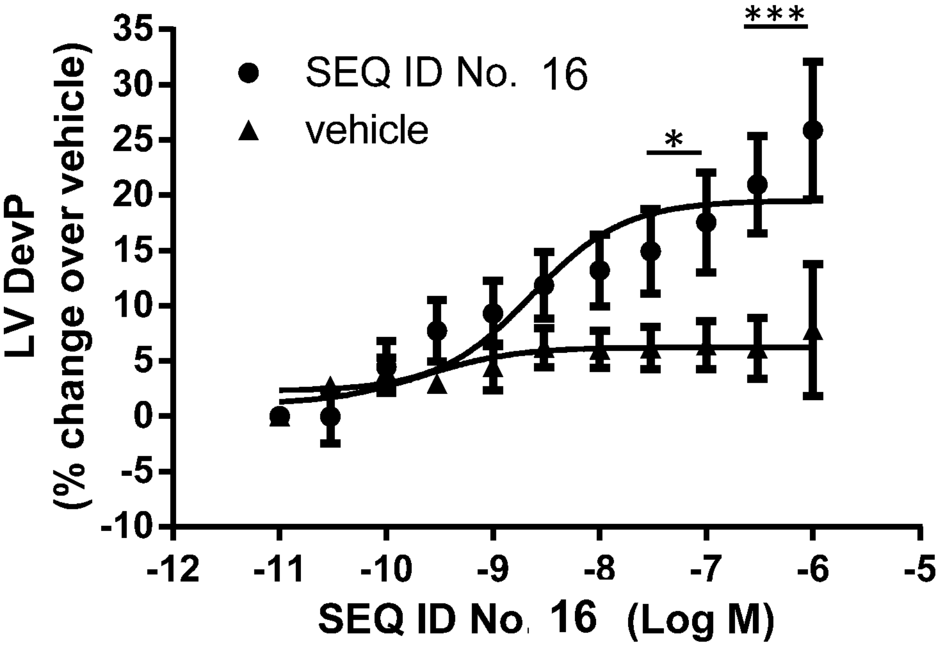
Figure 4C:
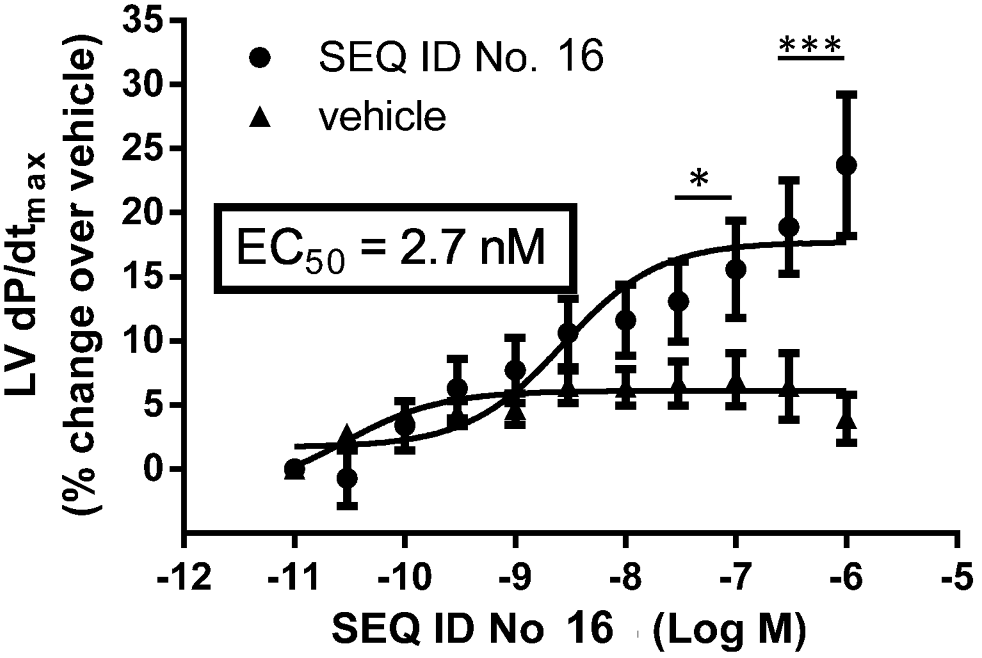
Figure 4D:
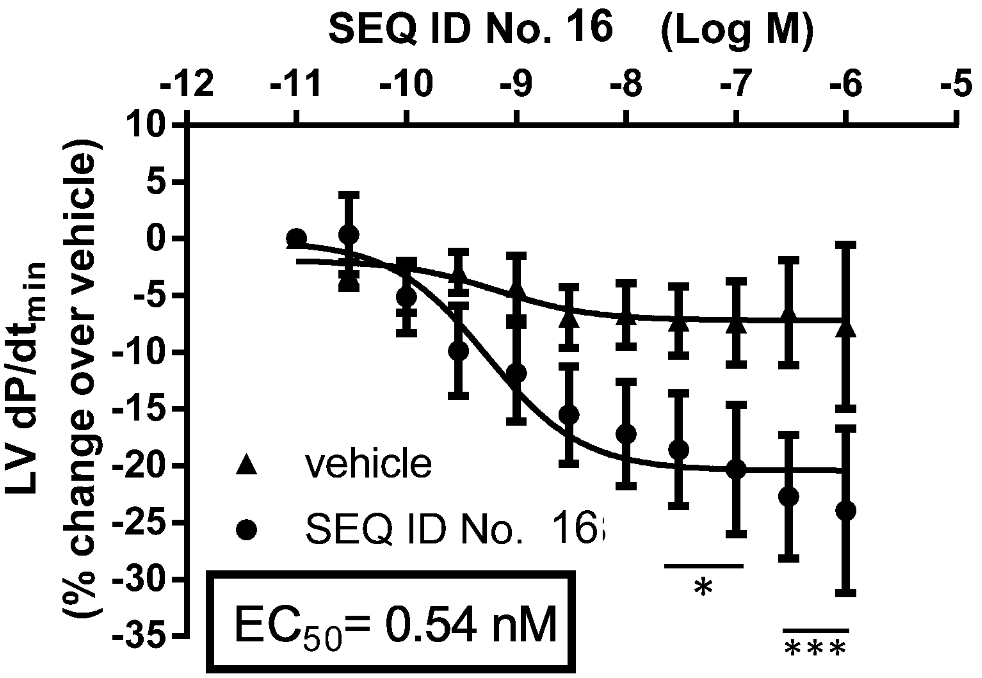
Figure 5A:
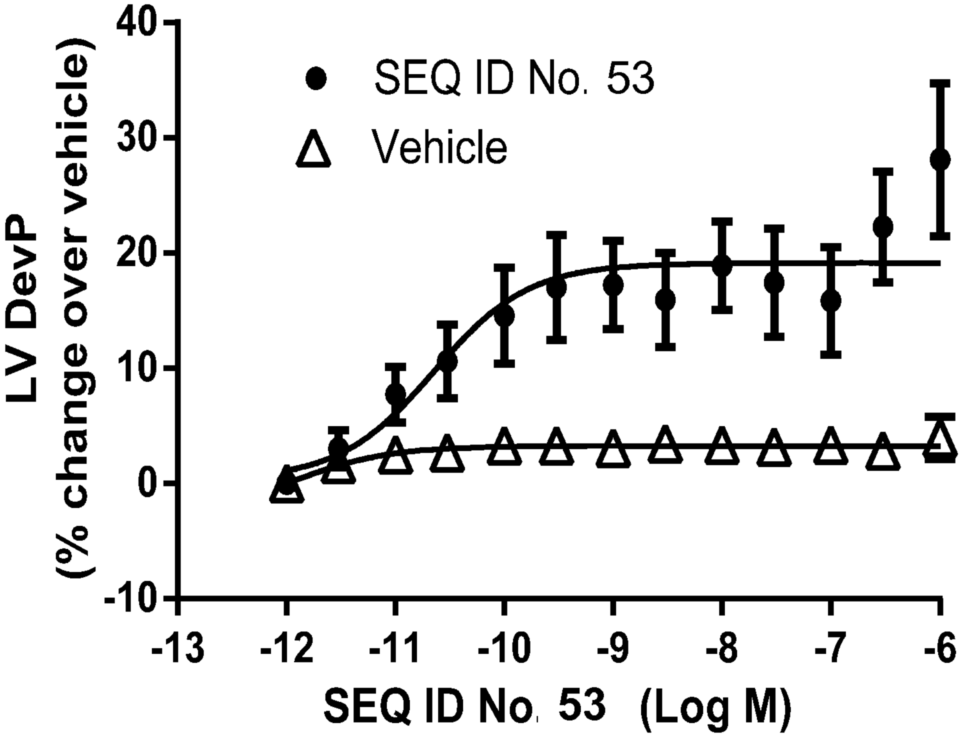
FIGS. 5A-5D show inotropic effects of apelin polypeptide SEQ ID NO: 53 (N=8) as compared with vehicle (N=7) in isolated perfused rat hearts.
Figure 5B:
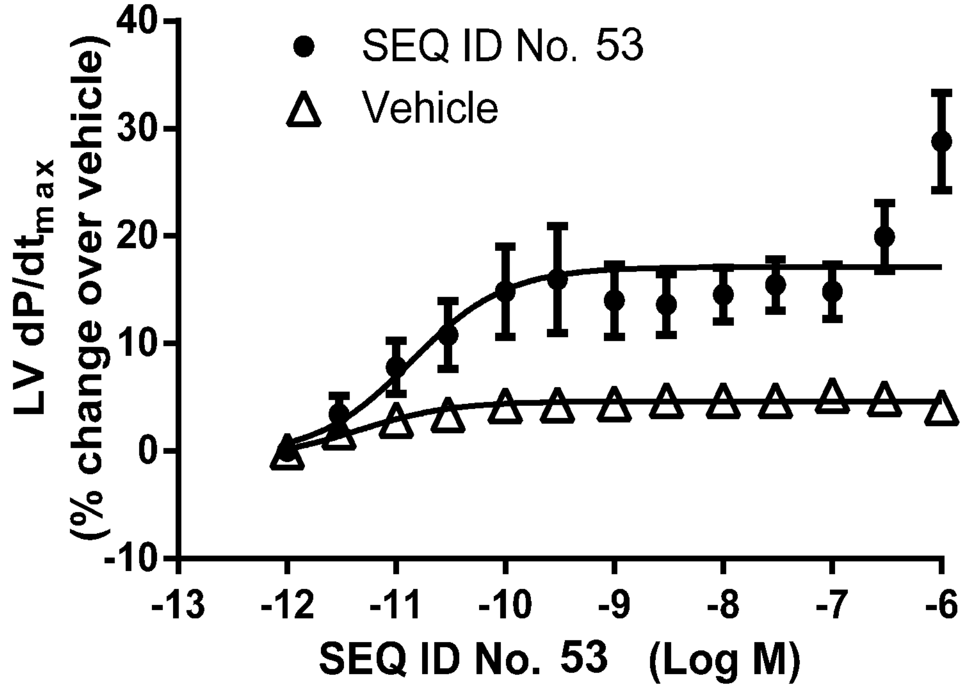
Figure 5C:
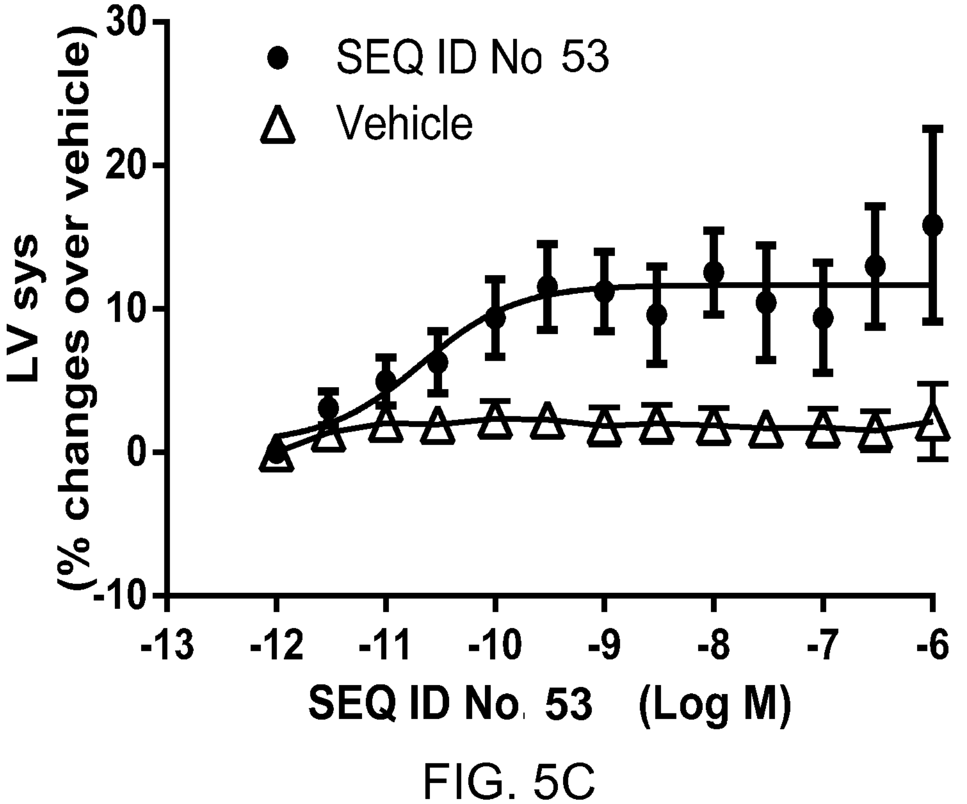
Figure 5D:
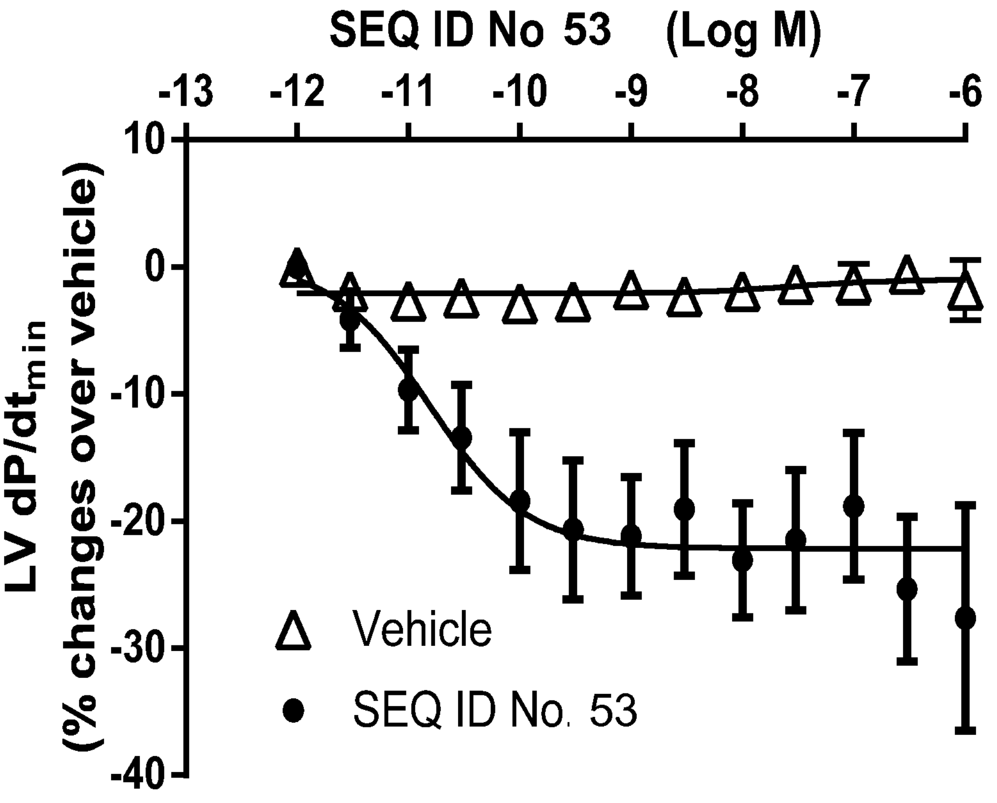
Figure 6A:
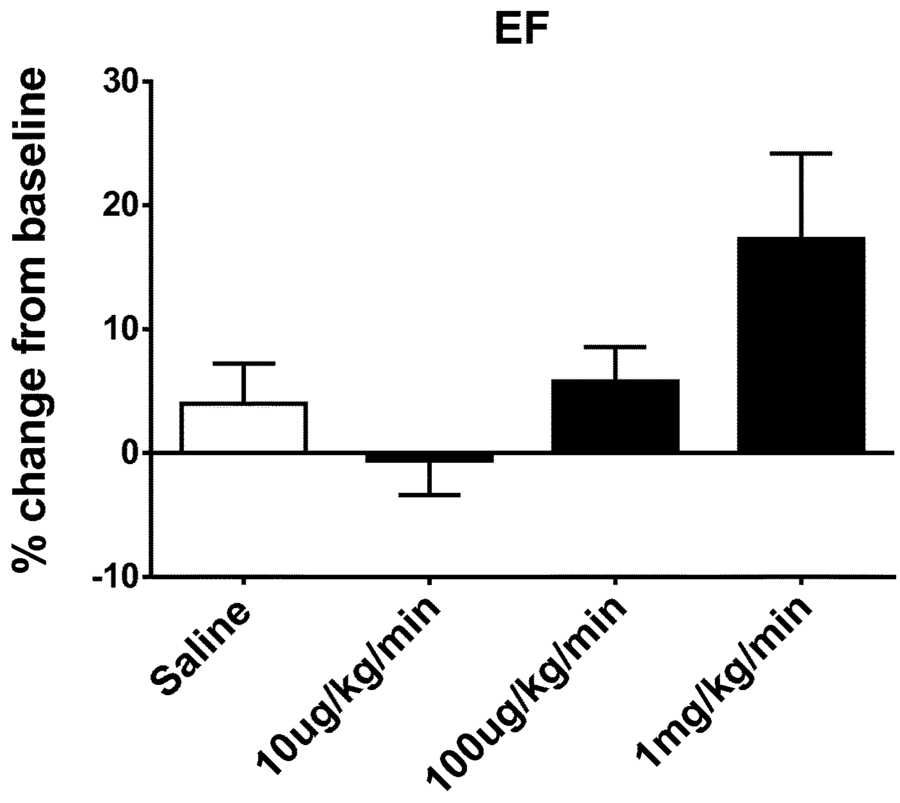
FIGS. 6A-6D show the pharmacodynamic effects of pyr-apelin13 (SEQ ID NO: 6) in rats with heart failure.
Figure 6B:
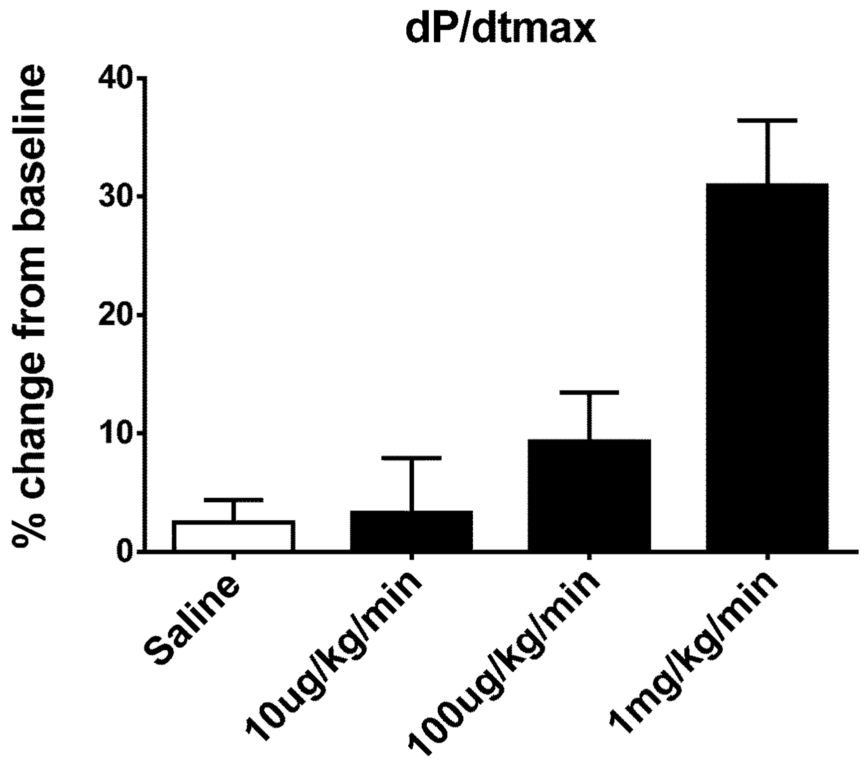
Figure 6C:
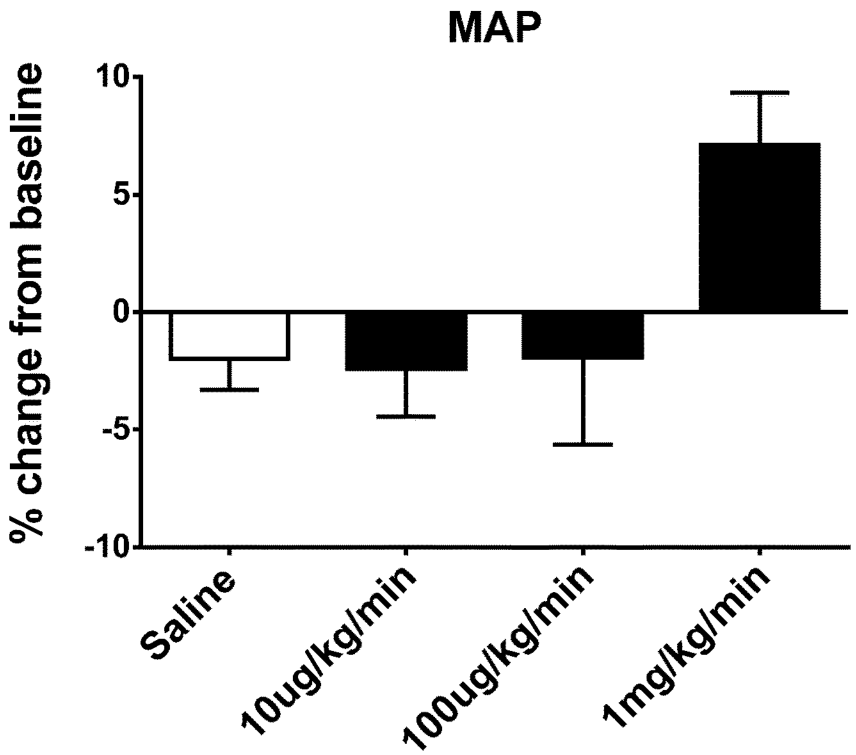
Figure 6D:
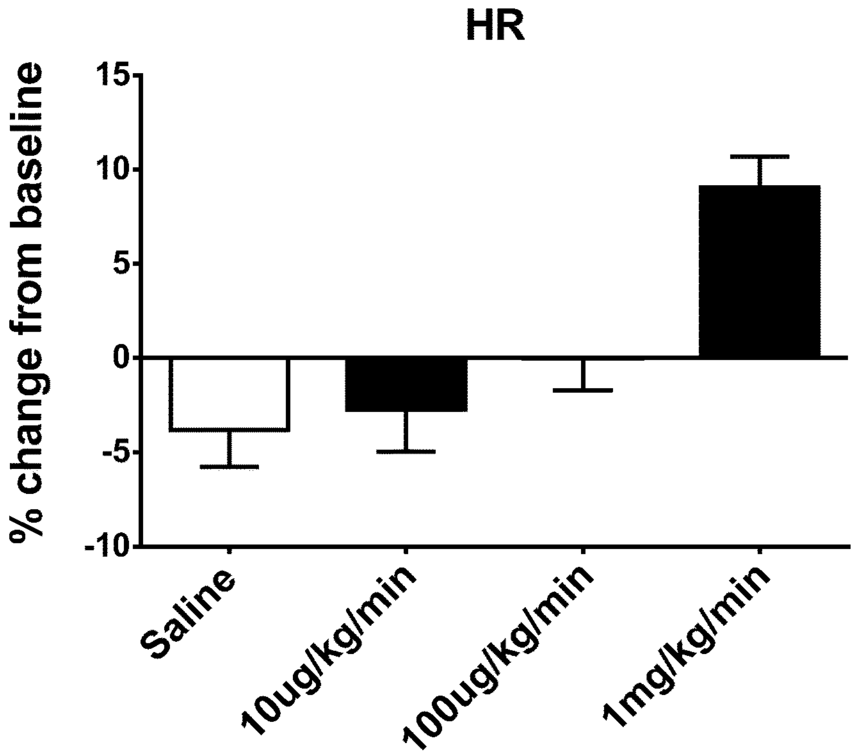
Figure 7A:
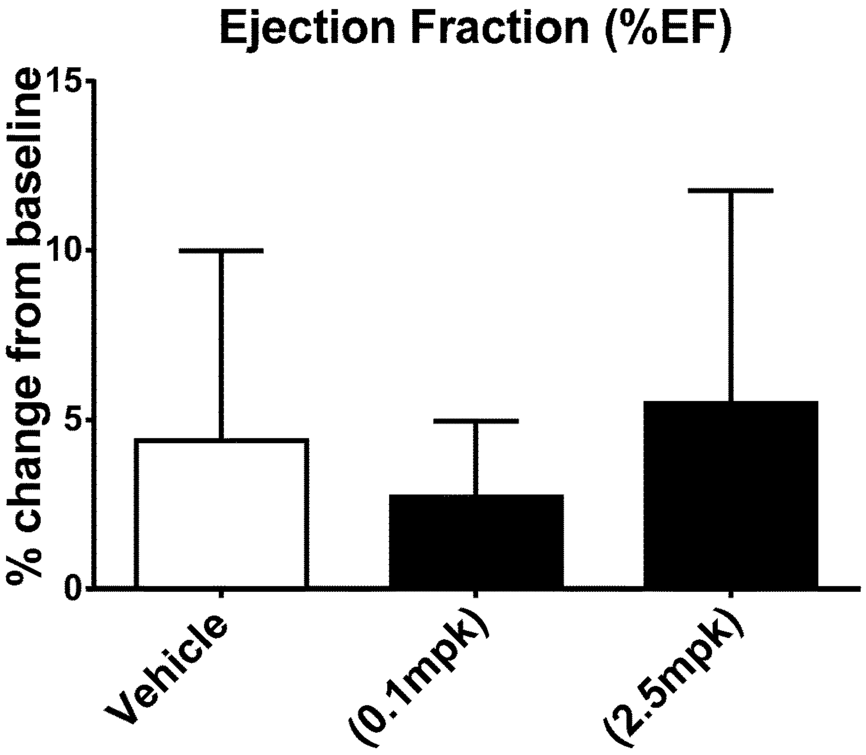
FIGS. 7A-7D show the pharmacodynamic effects of apelin polypeptide SEQ ID NO: 109 in rats with heart failure.
Figure 7B:
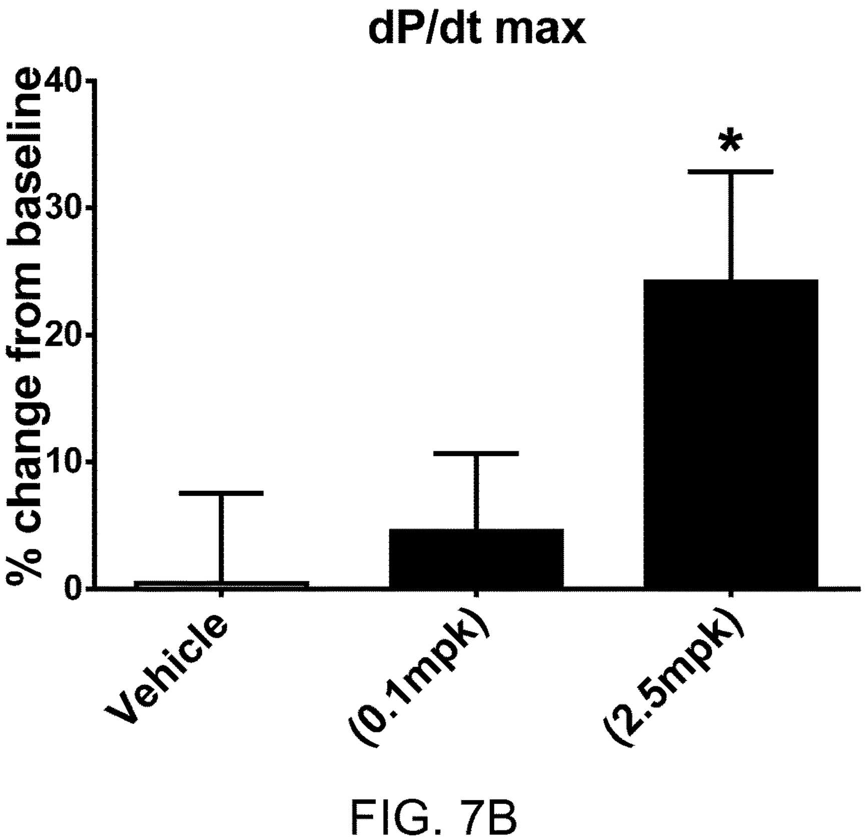
Figure 7C:
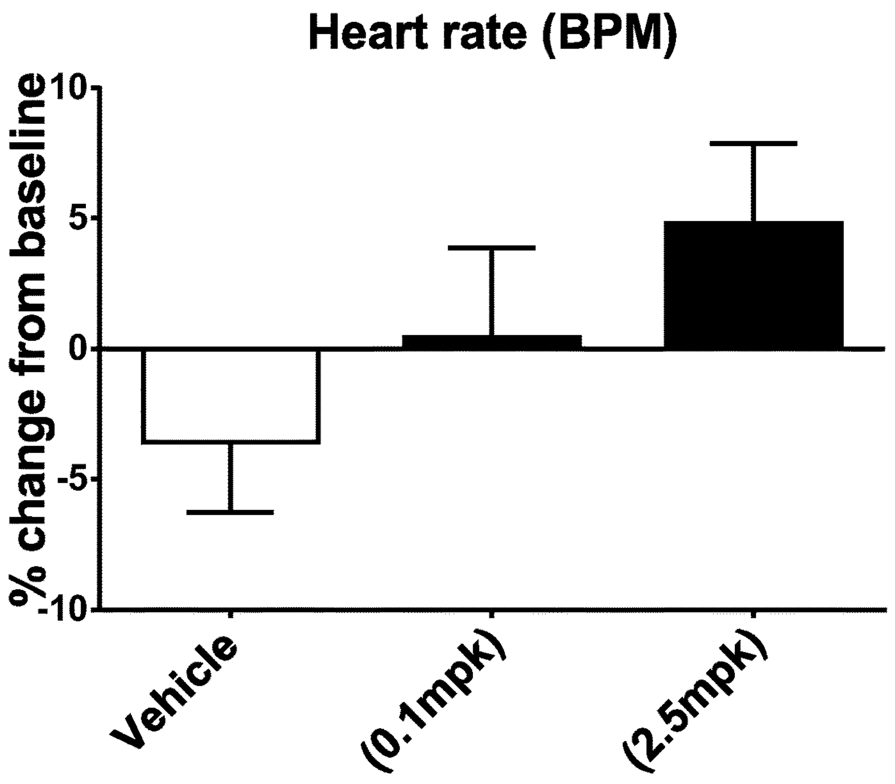
Figure 7D:
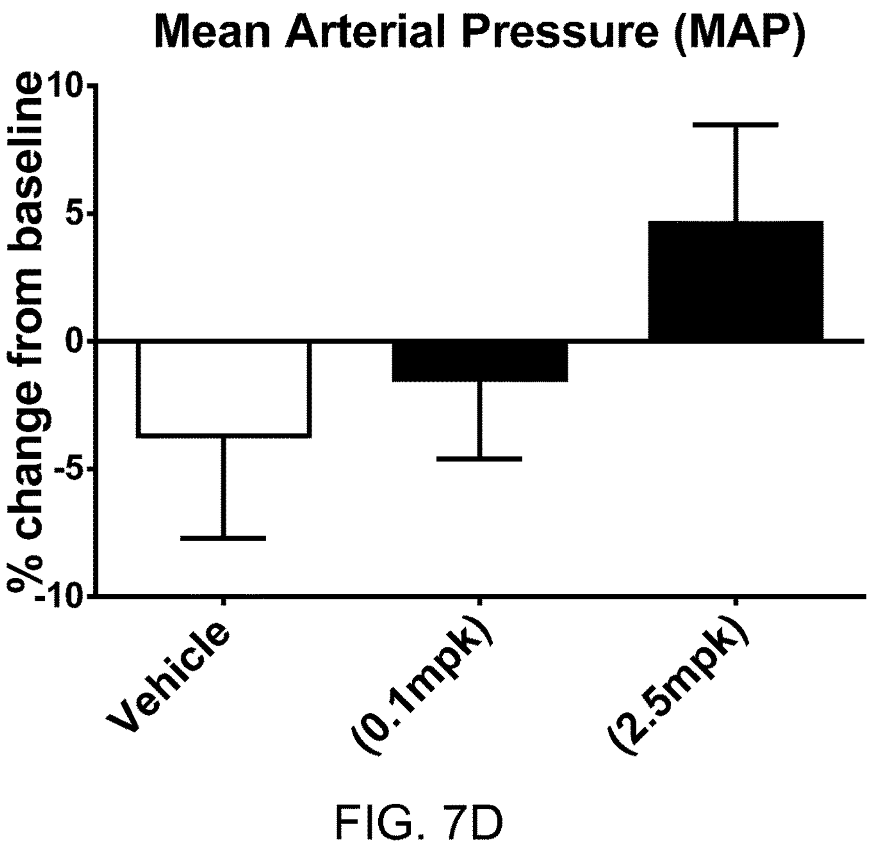
Figure 8A:
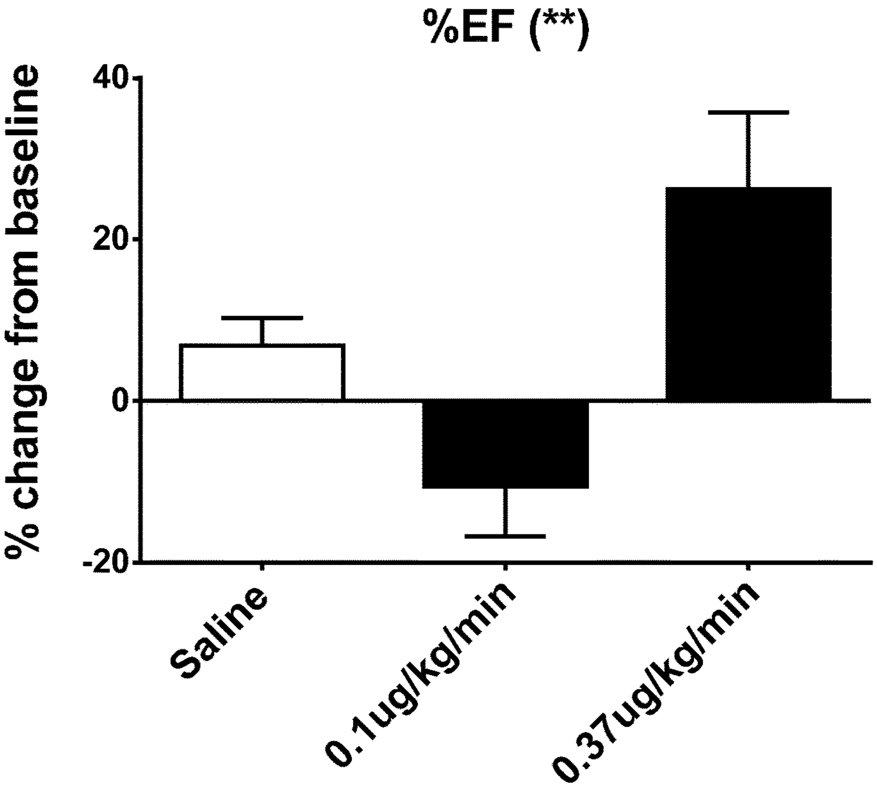
FIGS. 8A-8D show the pharmacodynamic effects of apelin polypeptide SEQ ID NO: 16 in rats with heart failure.
Figure 8B:
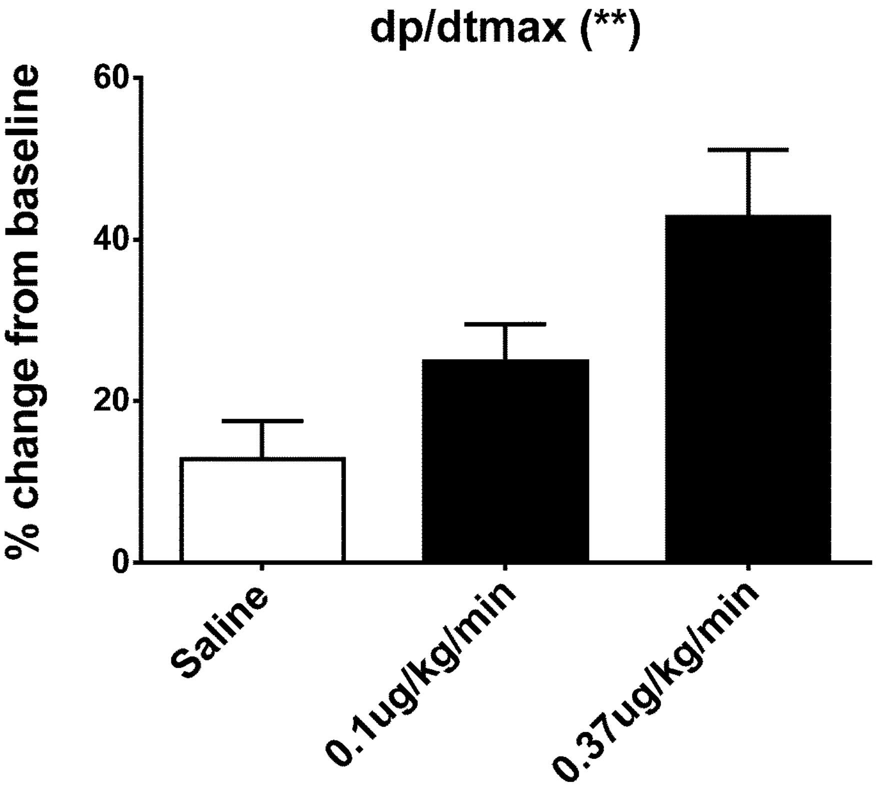
Figure 8C:
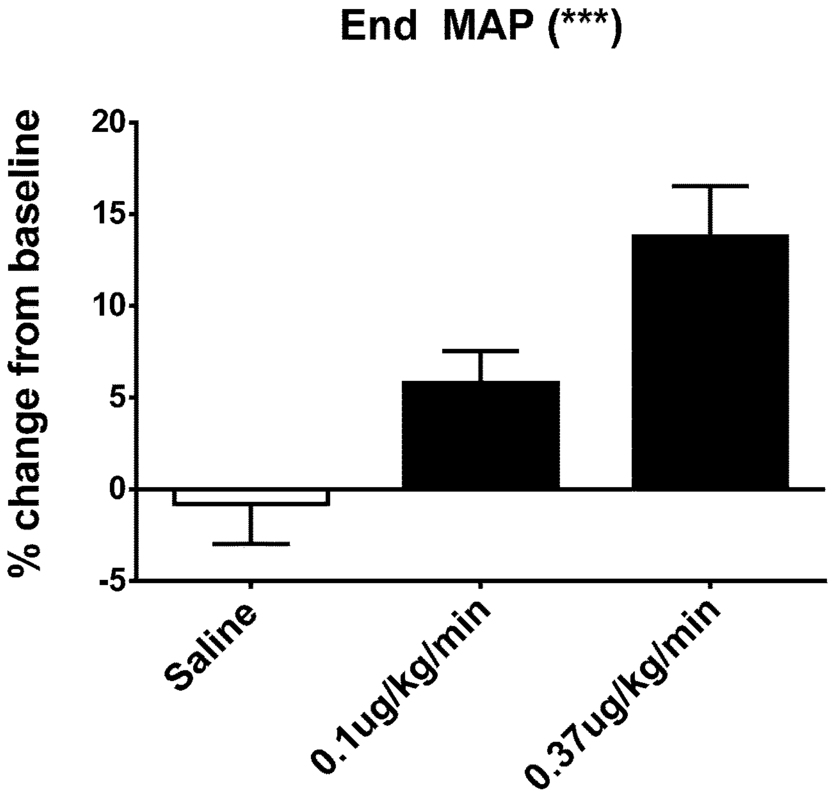
Figure 8D:
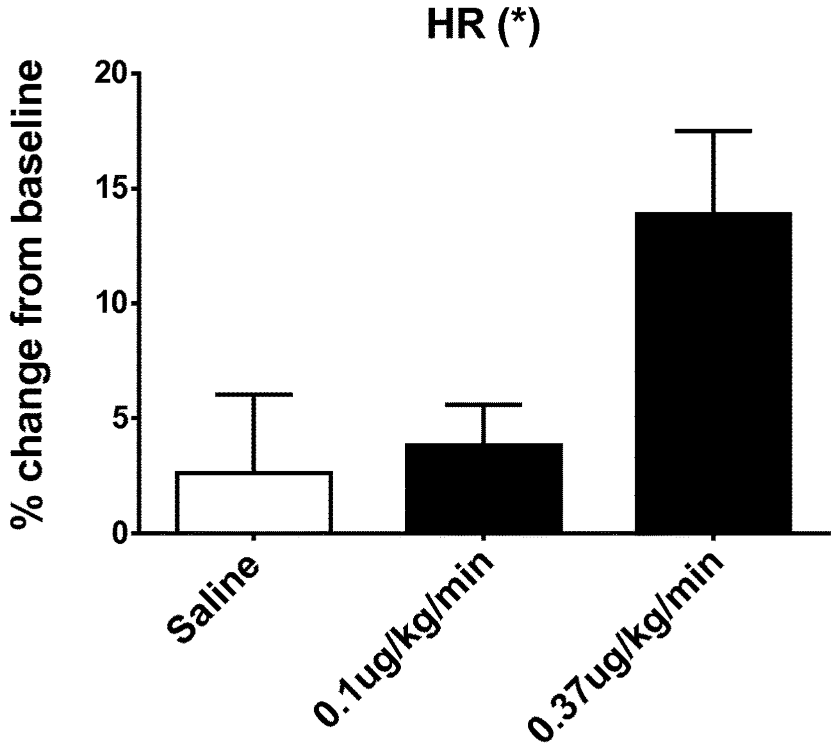

In various embodiments, the apelin polypeptide and/or vehicle/carrier portion of the compounds described herein may be derivatized. Such derivatives may improve the solubility, absorption, stability, biological half-life, and the like of the compounds. The derivative moieties may alternatively eliminate or attenuate any undesirable effects of the compounds, such as induction of mast cell degranulation. Various derivitization strategies, which have been used in making the modified apelin polypeptides of the invention and are particularly useful for increasing the stability of apelin peptides, are set forth in FIG. 3.

"Chemical derivative" or "chemically derivatized" also refers to a subject peptide having one or more residues chemically derivatized by reaction of a functional side group. Such derivatized molecules include, for example, those molecules in which free amino groups have been derivatized to form amine hydrochlorides, p-toluene sulfonyl groups, carbobenzoxy groups, t-butyloxycarbonyl groups, chloroacetyl groups or formyl groups. Free carboxyl groups may be derivatized to form salts, methyl and ethyl esters or other types of esters or hydrazides. Free hydroxyl groups may be derivatized to form O-acyl or O-alkyl derivatives. The imidazole nitrogen of histidine may be derivatized to form N-im-benzylhistidine. Also included as chemical derivatives are those peptides which contain one or more naturally occurring amino acid derivatives of the twenty canonical amino acids, whether in L- or D-form. For example, 4-hydroxyproline may be substituted for proline; 5-hydroxylysine may be substituted for lysine; 3-methylhistidine may be substituted for histidine; homoserine may be substituted for serine; and ornithine may be substituted for lysine.

Useful derivatizations include, in some embodiments, those in which the amino terminal of the peptide is chemically blocked so that conjugation with a vehicle or carrier will be prevented from taking place at an N-terminal free amino group. There may also be other beneficial effects of such a modification, for example a reduction in the apelin peptide analog's susceptibility to enzymatic proteolysis. The N-terminus can be acylated or modified to a substituted amine, or derivatized with another functional group, such as an aromatic moiety (e.g., an indole acid, benzyl (Bzl or Bn), dibenzyl (DiBzl or Bn2), or benzyloxycarbonyl (Cbz or Z)), N,N-dimethylglycine or creatine. For example, in some embodiments, an acyl moiety, such as, but not limited to, a formyl, acetyl (Ac), propanoyl, butanyl, heptanyl, hexanoyl, octanoyl, or nonanoyl, can be covalently linked to the N-terminal end of the peptide, which can prevent undesired side reactions during conjugation of the vehicle or carrier to the peptide. Other exemplary N-terminal derivative groups include —$NRR^1$(other than —$NH_2$), —$NRC(O)R^1$, —$NRC(O)OR^1$, —$NRS(O)_2R^1$, —$NHC(O)NHR^1$, succinimide, or benzyloxycarbonyl-NH— (Cbz-NH—), wherein R and $R^1$ are each independently hydrogen or lower alkyl and wherein the phenyl ring may be substituted with 1 to 3 substituents selected from $C_1$-$C_4$ alkyl, $C_1$-$C_4$ alkoxy, chloro, and bromo.

In some embodiments, one or more peptidyl [—C(O)NR-] linkages (bonds) between amino acid residues can be replaced by a non-peptidyl linkage. Exemplary non-peptidyl linkages are —$CH_2$-carbamate [—$CH_2$—OC(O)NR—], phosphonate, —$CH_2$-sulfonamide [—$CH_2$—$S(O)_2NR$—], urea [—NHC(O)NH—], —$CH_2$-secondary amine, and alkylated peptide [—C(O)$NR^6$— wherein $R^6$ is lower alkyl].

In some embodiments, one or more individual amino acid residues can be derivatized. Various derivatizing agents are known to react specifically with selected sidechains or terminal residues, as described in detail below by way of example.

Lysinyl residues and amino terminal residues may be reacted with succinic or other carboxylic acid anhydrides, which reverse the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4 pentanedione; and transaminase-catalyzed reaction with glyoxylate.

Arginyl residues may be modified by reaction with any one or combination of several conventional reagents, including phenylglyoxal, 2,3-butanedione, 1,2-cyclohexanedione, and ninhydrin. Derivatization of arginyl residues requires that the reaction be performed in alkaline conditions because of the high pKa of the guanidine functional group. Furthermore, these reagents may react with the groups of lysine as well as the arginine epsilon-amino group.

Specific modification of tyrosyl residues has been studied extensively, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively.

Carboxyl sidechain groups (aspartyl or glutamyl) may be selectively modified by reaction with carbodiimides (R'—N═C═N—R') such as 1-cyclohexyl-3-(2-morpholinyl-(4-ethyl) carbodiimide or 1-ethyl-3-(4-azonia-4,4-dimethylpentyl) carbodiimide. Furthermore, aspartyl and glutamyl residues may be converted to asparaginyl and glutaminyl residues by reaction with ammonium ions.

Glutaminyl and asparaginyl residues may be deamidated to the corresponding glutamyl and aspartyl residues. Alternatively, these residues are deamidated under mildly acidic conditions. Either form of these residues falls within the scope of this invention.

Cysteinyl residues can be replaced by amino acid residues or other moieties either to eliminate disulfide bonding or, conversely, to stabilize cross-linking. See, e.g., Bhatnagar et al., J. Med. Chem., 39:3814-3819, 1996.

Derivatization with bifunctional agents is useful for cross-linking the peptides or their functional derivatives to a water-insoluble support matrix, if desired, or to other macromolecular vehicles. Commonly used cross-linking agents include, e.g., 1,1-bis (diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates, e.g., as described in U.S. Pat. Nos. 3,969,287; 3,691,016; 4,195,128; 4,247,642; 4,229,537; and 4,330,440, are employed for protein immobilization.

Other possible modifications include hydroxylation of proline and lysine, phosphorylation of hydroxyl groups of seryl or threonyl residues, oxidation of the sulfur atom in Cys, methylation of the alpha-amino groups of lysine, arginine, and histidine side chains. Creighton, Proteins: Structure and Molecule Properties, W. H. Freeman & Co., San Francisco, 79-86, 1983.

The above examples of derivatizations are not intended to be an exhaustive treatment, but merely illustrative.

Recombinant DNA- and/or RNA-mediated protein expression and protein engineering techniques, or any other methods of preparing peptides, are applicable to the making of the apelin polypeptides disclosed herein. The term "recombinant" should be understood to mean that the material (e.g., a nucleic acid or a polypeptide) has been artificially or synthetically (i.e., non-naturally) altered by human intervention. The alteration can be performed on the material within, or removed from, its natural environment or state. For example, a "recombinant nucleic acid" is one that is made by recombining nucleic acids, e.g., during cloning, DNA shuffling or other well-known molecular biological procedures. Examples of such molecular biological procedures are found in Maniatis et al., Molecular Cloning. A Laboratory Manual. Cold Spring Harbor Laboratory, Cold Spring Harbor, N.Y., 1982. A "recombinant DNA molecule," is comprised of segments of DNA joined together by means of such molecular biological techniques. The term "recombinant protein" or "recombinant polypeptide" as used herein refers to a protein molecule which is expressed using a recombinant DNA molecule. A "recombinant host cell" is a cell that contains and/or expresses a recombinant nucleic acid.

The peptides of the invention may be made in transformed host cells according to methods known to those of skill in the art. Briefly, a recombinant DNA molecule, or construct, coding for the peptide is prepared. Methods of preparing such DNA molecules are well known in the art. For instance, sequences encoding the peptides can be excised from DNA using suitable restriction enzymes. Any of a large number of available and well-known host cells may be used in the practice of various embodiments. The selection of a particular host is dependent upon a number of factors recognized by the art. These include, for example, compatibility with the chosen expression vector, toxicity of the peptides encoded by the DNA molecule, rate of transformation, ease of recovery of the peptides, expression characteristics, biosafety and costs. A balance of these factors should be struck with the understanding that not all hosts may be equally effective for the expression of a particular DNA sequence. Within these general guidelines, useful microbial host cells in culture include bacteria (such as *Escherichia coli* sp.), yeast (such as *Saccharomyces* sp.) and other fungal cells, insect cells, plant cells, mammalian (including human) cells, e.g., CHO cells and HEK293 cells. Modifications can be made at the DNA level, as well. The peptide-encoding DNA sequence may be changed to codons more compatible with the chosen host cell. For *E. coli*, optimized codons are known in the art. Codons can be substituted to eliminate restriction sites or to include silent restriction sites, which may aid in processing of the DNA in the selected host cell. Next, the transformed host is cultured and purified. Host cells may be cultured under conventional fermentation conditions so that the desired compounds are expressed. Such fermentation conditions are well known in the art. In addition, the DNA optionally further encodes, 5' to the coding region of a fusion protein, a signal peptide sequence (e.g., a secretory signal peptide) operably linked to the expressed peptide analog. For further examples of appropriate recombinant methods and exemplary DNA constructs useful for recombinant expression of the compositions by mammalian cells, including dimeric Fc fusion proteins ("peptibodies") or chimeric immunoglobulin (light chain+heavy chain)-Fc heterotrimers ("hemibodies"), see, e.g., Sullivan et al., Toxin Peptide Therapeutic Agents, U.S. Patent Publication No. 2007/0071764 and Sullivan et al., Toxin Peptide Therapeutic Agents, WO 2008/088422, which are both incorporated herein by reference in their entireties.

The modified apelin polypeptides of the invention can also be made by synthetic methods. Solid phase synthesis can be used as a technique of making individual peptides since it is the most cost-effective method of making small peptides. For example, well known solid phase synthesis techniques include the use of protecting groups, linkers, and solid phase supports, as well as specific protection and deprotection reaction conditions, linker cleavage conditions, use of scavengers, and other aspects of solid phase peptide synthesis. Suitable techniques are well known in the art. See, e.g., Merrifield, Chem. Polypeptides, Katsoyannis and Panayotis eds., pp. 335-361, 1973; Merrifield, J. Am. Chem. Soc. 85: 2149, 1963; Davis et al., Biochem. Intl. 10:394-414, 1985; Stewart and Young, Solid Phase Peptide Synthesis, 1969; U.S. Pat. No. 3,941,763; Finn et al., The Proteins, 3rd ed., 2:105-253, 1976; and Erickson et al., The Proteins, 3rd ed., 2: 257-527, 1976; "Protecting Groups in Organic Synthesis," 3rd ed., T. W. Greene and P. G. M. Wuts, Eds., John Wiley & Sons, Inc., 1999; NovaBiochem Catalog, 2000; "Synthetic Peptides, A User's Guide," G. A. Grant, Ed., W.H. Freeman & Company, New York, N.Y., 1992; "Advanced Chemtech Handbook of Combinatorial & Solid Phase Organic Chemistry," W. D. Bennet, J. W. Christensen, L. K. Hamaker, M. L. Peterson, M. R. Rhodes, and H. H. Saneii, Eds., Advanced Chemtech, 1998; "Principles of Peptide Synthesis, 2nd ed.," M. Bodanszky, Ed., Springer-Verlag, 1993; "The Practice of Peptide Synthesis, 2nd ed.," M. Bodanszky and A. Bodanszky, Eds., Springer-Verlag, 1994; "Protecting Groups," P. J. Kocienski, Ed., Georg Thieme Verlag, Stuttgart, Germany, 1994; "Fmoc Solid Phase Peptide Synthesis, A Practical Approach," W. C. Chan and P. D. White, Eds., Oxford Press, 2000; G. B. Fields et al., Synthetic Peptides: A User's Guide, 77-183, 1990. For further examples of synthetic and purification methods known in the art, which are applicable to making the polypeptides and conjugates of the invention, see, e.g., Sullivan et al, U.S. Patent Publication No. 2007/0071764 and Sullivan et al., WO 2008/088422 A2, which are both incorporated herein by reference in their entireties.

The modified apelin polypeptides of the invention may be covalently fused, attached, linked or conjugated to one or more half-life extending moieties or vehicles. A "half-life extending moiety," which is used interchangeably herein with "vehicle," refers to a molecule that prevents or mitigates in vivo degradation by proteolysis or other activity-diminishing chemical modification, increases in vitro or in vivo half-life or other pharmacokinetic properties, such as but not limited to decreasing the rate of renal or hepatic clearance, increasing the rate of absorption, reducing toxicity, reducing immunogenicity, improving solubility, increasing biological activity and/or target selectivity of the apelin peptide with respect to a target of interest, and/or increases manufacturability, compared to an unconjugated form of the apelin peptide. The half-life extending moiety can be one that is pharmaceutically acceptable.

A composition that includes an apelin peptide or polypeptide covalently linked, attached, or bound, either directly or indirectly through a linker moiety, to another peptide, vehicle, or a half-life extending moiety is a "conjugate" or "conjugated" molecule, whether conjugated by chemical means (e.g., post-translationally or post-synthetically) or by recombinant fusion. Conjugation of the apelin polypeptides to the half-life extending moiety, or moieties, can be via the N-terminus and/or C-terminus of the apelin peptide, or can be intercalary as to the peptide's primary amino acid sequence. In certain embodiments, the half-life extending moiety is conjugated to the N-terminus of the modified apelin polypeptide.

The half-life extending moiety or vehicle can be selected such that the resulting peptide conjugate achieves a sufficient hydrodynamic size to prevent clearance by renal filtration in vivo. For example, a half-life extending moiety can be selected that is a polymeric macromolecule, which is substantially straight chain, branched-chain (br), or dendritic in form. Alternatively, a half-life extending moiety can be selected such that, in vivo, the resulting peptide conjugate will bind to a serum protein to form a complex, such that the complex thus formed avoids substantial renal clearance. The half-life extending moiety or vehicle can be, for example, a polymer (e.g., polyethylene glycol (PEG)); a lipid; a cholesterol group (such as a steroid); a carbohydrate or oligosaccharide (e.g., dextran); any natural or synthetic protein (e.g., an antibody or Fc domain), or any polypeptide or peptide that binds to a salvage receptor.

Exemplary half-life extending moieties that can be used, in accordance with the present invention, include an immunoglobulin, an immunoglobulin Fc domain, or a portion thereof, or a biologically suitable polymer or copolymer, for example, a polyalkylene glycol compound, such as a polyethylene glycol (PEG) or a polypropylene glycol. Other appropriate polyalkylene glycol compounds include, but are not limited to, charged or neutral polymers of the following types: dextran, polylysine, colominic acids or other carbohydrate based polymers, polymers of amino acids, and biotin derivatives. In some embodiments, an immunoglobulin (including light and heavy chains) or a portion thereof, can be used as a half-life-extending moiety, preferably an immunoglobulin of human origin, and including any of the immunoglobulins, such as, but not limited to, IgG1, IgG2, IgG3 or IgG4.

Other examples of the half-life extending moiety or vehicle, in accordance with the invention, include a copolymer of ethylene glycol, a copolymer of propylene glycol, a carboxymethylcellulose, a polyvinyl pyrrolidone, a poly-1,3-dioxolane, a poly-1,3,6-trioxane, an ethylene maleic anhydride copolymer, a polyaminoacid (e.g., polylysine or polyornithine), a dextran n-vinyl pyrrolidone, a poly n-vinyl pyrrolidone, a propylene glycol homopolymer, a propylene oxide polymer, an ethylene oxide polymer, a polyoxyethylated polyol, a polyvinyl alcohol, a linear or branched glycosylated chain, a polyacetal, a long chain fatty acid, a long chain hydrophobic aliphatic group, or a polysialic acid (e.g., PolyXen™ technology; Gregoriadis et al., Improving the therapeutic efficacy of peptides and proteins: a role for polysialic acids, Intl. J. Pharmaceutics, 300:125-130, 2005, incorporated herein by reference in its entirety).

In other embodiments, the half-life extending moiety is an anionically charged chemical entity, covalently linked to the N-terminus of the apelin peptide. Anionically charged chemical entities include, but are not limited to, phosphotyrosine, phosphoserine, p-phosphono(difluoro-methyl)-phenylalanine (Pfp), p-phosphono-methyl-phenylalanine (Pmp), p-phosphatidyl-phenylalanine (Ppa), or p-phosphono-methylketo-phenylalanine (Pkp), which can be covalently linked to the N-terminal of the apelin peptide, optionally indirectly, via an AEEA linker or other linker as described herein. See WO 2006/042151 A2; Beeton et al., "Targeting effector memory T cells with a selective peptide inhibitor of Kv1.3 channels for therapy of autoimmune diseases", Molec. Pharmacol. 67(4):1369-1381, 2005; Pennington et al., "Engineering a stable and selective peptide blocker of the Kv1.3 channel in T lymphocytes", Molecular Pharmacology Fast Forward, published Jan. 2, 2009 as doi:10.1124/mol.108.052704, all of which are incorporated herein by reference in their entireties.

Other embodiments of the half-life extending moiety, in accordance with the invention, include peptide ligands or small (organic) molecule ligands that have binding affinity for a long half-life serum protein under physiological conditions of temperature, pH, and ionic strength. Examples include an albumin-binding peptide or small molecule ligand, a transthyretin-binding peptide or small molecule ligand, a thyroxine-binding globulin-binding peptide or small molecule ligand, an antibody-binding peptide or small molecule ligand, or another peptide or small molecule that has an affinity for a long half-life serum protein, such as serum albumin. See, e.g., Kratz, "Albumin as a drug carrier: Design of prodrugs, drug conjugates and nanoparticles", J. Controlled Release, 132:171-183, 2008; Dennis et al., "Albumin binding as a general strategy for improving the pharmacokinetics of proteins", J. Biol. Chem. 277(38): 35035-35043, 2002; Knudsen et al., "Potent derivative of glucagon-like Peptide-1 with pharmacokinetic properties suitable for once daily administration", J. Med. Chem. 43:1664-1669, 2000; Kurtzhals et al., "Albumin binding of insulins acylated with fatty acids: characterization of the ligand-protein interaction and correlation between binding affinity and timing of the insulin effect in vivo", Biochem. J. 312:725-731, 1995; Kenyon et al., "13C NMR Studies of the binding of medium-chain fatty acids to human serum albumin", J. Lipid Res. 35:458-467, 1994; Blaney et al., "Method and compositions for increasing the serum half-life of pharmacologically active agents by binding to transthyretin-selective ligands", U.S. Pat. No. 5,714,142; Sato et al., "Serum albumin binding moieties", U.S. Patent Publication No. 2003/0069395 A1; and U.S. Pat. No. 6,342,225. Exemplary small molecule ligands that can bind to human serum albumin include, but are not limited to, pIFBu ((S)-2-(4-(4-iodophenyl)butanamido)pentanedioic acid) and DOTA (2,2',2'',2'''-(1,4,7,10-tetraazacyclododecane-1,4,7,10-tetrayl)tetraacetic acid). Such ligands can be attached to the modified apelin polypeptides of the invention, such as in polypeptide of SEQ ID NO: 118 ({pIFBu}[AC4Abu][Aeea][Aeea]QRP[NMeArg]LSHKGP[Nle]P[4-Cl-F]{COOH}), to increase serum half-life.

A "long half-life serum protein" is one of the hundreds of different proteins dissolved in mammalian blood plasma, including so-called "carrier proteins" (such as albumin, transferrin and haptoglobin), fibrinogen and other blood coagulation factors, complement components, immunoglobulins, enzyme inhibitors, precursors of substances such as angiotensin and bradykinin and many other types of proteins. The invention encompasses the use of any single species of pharmaceutically acceptable half-life extending moiety, such as, but not limited to, those described herein, or the use of a combination of two or more different half-life extending moieties, such as PEG and immunoglobulin Fc domain or a portion thereof (see, e.g., Feige et al., "Modified peptides as therapeutic agents", U.S. Pat. No. 6,660,843), such as a CH2 domain of Fc, albumin (e.g., human serum albumin (HSA); see, e.g., Ehrlich et al., "Preparation and characterization of albumin conjugates of a truncated Peptide YYY analogue for half-life extension", Bioconjugate Chem., 24(12):2015-2024, 2013; U.S. Pat. No. 6,926,898; U.S. Patent Publication No. 2005/0054051; U.S. Pat. No. 6,887,470), a transthyretin (TTR; see, e.g., U.S. Patent Publication Nos. 2003/0195154 A1 and 2003/0191056 A1), or a thyroxine-binding globulin (TBG), or a combination such as immunoglobulin(light chain+heavy chain) and Fc domain (the heterotrimeric combination a so-called "hemibody"), for example as described in WO 2008/088422, which is incorporated herein by reference in its entirety.

Extending the half-life of the modified apelin polypeptide can also be referred to as increased "stability." Increased stability can also be understood to mean reduced clearance of the apelin polypeptide or overall increased exposure of the apelin polypeptide or an apelin polypeptide with a modification or combination of modifications that reduces the rate of metabolic degradation relative to unmodified apelin polypeptide. Increased stability can prolong half-life of the apelin polypeptide in biological matrices such as plasma and tissue homogenates in vitro and prolong plasma residence times in vivo. In vivo plasma residence times should be understood to mean circulating life-time of the intact peptide drug entity administered into an animal. In vitro plasma residence times should be understood to mean life-time of the intact peptide drug entity after addition in biological medium.

Modifications of the apelin polypeptide can also lead to increased "potency" of the molecule, e.g. improving the pharmacokinetic or pharmacodynamic properties of the molecule. Increased potency can also be understood to mean an apelin polypeptide with a modification or combination of modifications that reduces the rate of metabolic degradation relative to unmodified apelin polypeptide. Increased stability can prolong half-life of the apelin polypeptide in biological matrices such as plasma and tissue homogenates in vitro and prolong plasma residence times in vivo. Increased potency may further be understood to mean increased affinity and/or efficacy of the modified apelin polypeptide for the APJ receptor.

In certain embodiments, one or more modified apelin polypeptides described herein is conjugated or attached to a half-life extension moiety or vehicle through the polypeptide's N-terminus, C-terminus, backbone, or side-chain via chemical modification in various configurations. Thus, in one embodiment, the vehicle-peptide conjugates may be described by the following formula I:

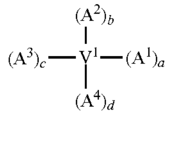

wherein:

$V^1$ is a vehicle (e.g. a PEG, lipid, or other half-life extension moiety);

$A^1$,$A^2$, $A^3$, and $A^4$ are each independently selected from $-(L^1)_e-P^1$, $-(L^1)_e-P-(L^2)_f-P^2$, $-(L)_e-P^1-(L^2)_f-P^2-(L^3)_g-P^3$, $-(L^1)_e-P^1-(L^2)_f-P^2-(L^3)_g-P^3-(L^4)_h-P^4$, and higher multimers thereof;

$P^1$, $P^2$ $P^3$, and $P^4$ are each independently sequences of apelin polypeptides and can be any of the apelin peptides described in this application without the lipid and/or Aeea and/or γ-glutamate and/or another moiety that comprises a portion of the conjugation linker, e.g. the apelin peptides with amino acid sequences of SEQ ID NOs: 121-647;

$L^1$, $L^2$, $L^3$, and $L^4$ are each independently linkers; and a, b, c, d, e, f, g, and h are each independently 0 or 1, provided that at least one of a, b, and c is 1.

In another embodiment, the vehicle-peptide conjugate is described by the following formula II:

$V^1$-$A^1$ and multimers thereof wherein $V^1$ is a PEG, lipid, or other half-life extension moiety, and is attached, with or without a linker, at the N-terminus of $A^1$;

In another embodiment, the vehicle-peptide conjugate is described by the following formula III:

and multimers thereof wherein $V^1$ is a PEG, lipid, or other half-life extension moiety, and is attached, with or without a linker, at the backbone or side-chain of $A^2$;

In another embodiment, the vehicle-peptide conjugate is described by the following formula IV:

$A^3$-$V^1$ and multimers thereof wherein $V^1$ is a PEG, lipid, or other half-life extension moiety, and is attached, with or without a linker, at the C-terminus of $A^3$;

In another embodiment, the vehicle-peptide conjugate is described by the following formula V:

$A^2$-$V^1$-$A^1$ and multimers thereof wherein $V^1$ is a PEG, lipid, or other half-life extension moiety, and is attached, with or without a linker, at any location of $A^1$ and $A^2$;

In another embodiment, the vehicle-peptide conjugate is described by the following formula VI;

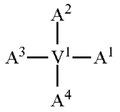

and multimers thereof wherein $V^1$ is a PEG, lipid, or other half-life extension moiety, and is attached, with or without a linker, at any location of $A^1$, $A^2$, $A^3$, or $A^4$;

In another embodiment, the vehicle-peptide conjugate is described by the following formula VII:

and multimers thereof wherein $V^1$ and $V^2$ are a PEG, lipid, or other half-life extension moiety, and are attached, with or without a linker, at any location of $A^1$.

In certain embodiments, γ-glutamate may be inserted into a modified apelin polypeptide of the invention. The γ-glutamate may be inserted between a lipid moiety (e.g. a fatty acid) and the modified apelin polypeptide. In addition to γ-glutamate, any other moiety may be present as a constituent of the conjugation linker as described in further detail herein. A constituent of the conjugation linker may be a polar, non-polar, hydrophobic, aliphatic, or aromatic moiety that serves a special, functional, and/or structural role.

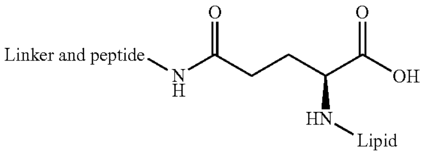

In certain embodiments, the half-life extension moiety or vehicle is a lipid. Thus, any of the modified apelin polypeptides disclosed herein can be conjugated, optionally through a conjugation linker, to a lipid moiety, such as a fatty acid. In some embodiments, the fatty acid is a $C_1$ to $C_{25}$ saturated or unsaturated fatty acid. Exemplary fatty acids that can be used as half-life extension moieties and conjugated to the modified apelin polypeptides of the invention, optionally through a conjugation linker, are listed in Table 6 below.

TABLE 6

| Exemplary Fatty Acid Moieties | | | |
|---|---|---|---|
| COMMON NAME | CHEMICAL NAME | CHEMICAL STRUCTURE | ABBREVIATION |
| Butyric acid | Butanoic acid | $CH_3(CH_2)_2COOH$ | Butanoyl |
| Caproic acid | Hexanoic acid | $CH_3(CH_2)_4COOH$ | Hexanoyl |
| Caprylic acid | Octanoic acid | CH3(CH2)$_6$COOH | Oc |
| Capric acid | decanoic acid | $CH_3(CH_2)_8COOH$ | Decanoyl |
| Lauric acid | dodecanoic acid | $CH_3(CH_2)_{10}COOH$ | Dodecanoyl, Dodc |
| Tridecylic acid | Tridecanoic acid | $CH_3(CH_2)_{11}COOH$ | TDA |
| Myristoic acid | tetradecanoic acid | $CH_3(CH_2)_{12}COOH$ | Myristyl, Myrist |
| Pentadecylic acid | Pentadecanoic acid | $CH_3(CH_2)_{13}COOH$ | PDA |
| Palmitic acid | Hexadecanoic acid | $CH_3(CH_2)_{14}COOH$ | Palm |
| margaric acid | Heptadecanoic acid | $CH_3(CH_2)_{15}COOH$ | HDA |
| Stearic acid | Octadecanoic acid | $CH_3(CH_2)_{16}COOH$ | St |
| Arachidic acid | icosanoic acid | $CH_3(CH_2)_{18}COOH$ | |
| Behenic acid | docosanoic acid | $CH_3(CH_2)_{20}COOH$ | |
| Lignoceric acid | tetracosanoic acid | $CH_3(CH_2)_{22}COOH$ | |
| Cerotic acid | hexacosanoic acid | $CH_3(CH_2)_{24}COOH$ | |
| Succinic acid | butanedioic acid | $HOOC(CH_2)_2COOH$ | Succinicacid |
| adipic acid | hexanedioic acid | $HOOC(CH_2)_4COOH$ | AdpA |
| Suberic acid | octanedioic acid | $HOOC(CH_2)_6COOH$ | Subericacid |

TABLE 6-continued

| Exemplary Fatty Acid Moieties | | | |
|---|---|---|---|
| COMMON NAME | CHEMICAL NAME | CHEMICAL STRUCTURE | ABBREVIATION |
| Sebacic acid | decanedioic acid | $HOOC(CH_2)_8COOH$ | Sebacicacid |
| DDDA | dodecanedioic acid | $HOOC(CH_2)_{10}COOH$ | DDDA |
| | tetradecanedioic acid | $HOOC(CH_2)_{12}COOH$ | TetDDA |
| | hexadecanedioic acid | $HOOC(CH_2)_{14}COOH$ | HexDDA |
| | Octadecandioic acid | $HOOC(CH_2)_{16}COOH$ | ODDA |

In some embodiments, the fatty acid or fatty acyl group conjugated to a modified apelin polypeptide of the invention is selected from Butanoyl, Hexanoyl, Octanoyl, Decanoyl, Dodecanoyl, Tridecanoyl, Tetradecanoyl, Pentadecanoyl, Hexadecanoyl, Heptadecanoyl, Octadecanoyl, Octadecandioyl, Octanedioyl, Decanedioyl, Dodecanedioyl, Hexanedioyl, Butanedioyl, Tetradecanedioyl, or Hexadecanedioyl. In other embodiments, the fatty acid or fatty acyl group conjugated to a modified apelin polypeptide of the invention is selected from Octadecandioyl, Heptadecanoyl, Tridecanoyl, Butanoyl, Hexanoyl, Hexadecanoyl, Butanedioyl, Octanedioyl, or Decanedioyl. In certain embodiments, the fatty acid or fatty acyl group conjugated to a modified apelin polypeptide of the invention is selected from Tridecanoyl, Butanoyl, Hexanoyl, Hexadecanoyl, Butanedioyl, Octanedioyl, or Decanedioyl. In certain other embodiments, the fatty acid or fatty acyl group conjugated to a modified apelin polypeptide of the invention is selected from Octanoyl, Decanoyl, Dodecanoyl, Tridecanoyl, Tetradecanoyl, Pentadecanoyl, Hexadecanoyl, Heptadecanoyl, Octadecanoyl, or Octadecandioyl.

In one embodiment of the invention, the lipid-apelin peptide conjugate can be described by the following formula:

$$X_1\ X_2\ X_3\ X_4 \quad \text{(SEQ ID NO: 721)}$$

wherein:

$X_1$ is a fatty acyl group, $X_2$ is γGlu or is absent, $X_3$ is a PEG group or is absent, and $X_4$ is an apelin polypeptide.

The amino acid residues in the apelin peptide of the above formula can be L- or D-amino acids, α- or β-amino acids, non-canonical amino acids or the L- or D- or α- or β-forms of the non-canonical amino acids. The apelin polypeptide in the above formula can be any of the modified apelin polypeptides described herein. In one embodiment, the PEG group is one or more AEEA ([2-(2-Amino-ethoxy)-ethoxy]-acetic acid) groups. In related embodiments, $X_2$ is γGlu (also referred to herein as AC4Abu) and $X_3$ is AEEA or AEEA-AEEA.

In another embodiment of the invention, the lipid-apelin peptide conjugate can be described by the following formula: {HDA}[AC4Abu][Aeea][Aeea] $X_1X_2X_3$P[Cha]SHKG[Oic][Nle]$X_4$ $X_5$ (SEQ ID No. 722), wherein: $X_1$ is [hArg] or is absent, $X_2$ is Q or [q], $X_3$ is [hArg] or [r], $X_4$ is P or [Pip] and $X_5$ is [4-Cl-F] or [D-4ClF]. In these and other embodiments, the lipid-peptide conjugate may comprise the sequence of SEQ ID NO: 237, 239, or 242.

In yet another embodiment of the invention, the lipid-apelin peptide conjugate can be described by the following formula: {HDA}[AC4Abu][Aeea][Aeea] $X_1X_2X_3$P$X_4X_5$SHKG[Oic][Nle]$X_6X_7$ (SEQ ID No. 723) wherein: $X_1$ is [hArg] or is absent, $X_2$ is Q or [q], $X_3$ is r or [hArg], $X_4$ is r or [NMeArg], $X_5$ is [NMeLeu] or [Cha], $X_6$ is [Pip] or P, and $X_7$ is [4-CL-F], [f], [D-4ClF], or [Tic]. In these and other embodiments, the lipid-peptide conjugate may comprise the sequence of any one of SEQ ID NOs: 234-243.

In some embodiments of the invention, the lipid-apelin peptide conjugate can be described by the following formula: {TDA}[AC4Abu][Aeea][Aeea] $X_1X_2X_3X_4$ $X_5X_6$ $X_7X_8$KG[Oic]$X_9X_{10}$ $X_{11}$ (SEQ ID NO: 724) wherein: $X_1$ is [hArg], [r] or is absent, $X_2$ is Q, [q], [BLeu] or [NMeGln], $X_3$ is [hArg] or [r], $X_4$ is P, [Pip], [Oic] or [Sar], $X_5$ is [NMeArg], [r] or [hArg], $X_6$ is [Cha], [NMeLeu], [BLeu] or [NMeCha], $X_7$ is S, [BhSer], [bAla], [NhSerG] or [aMeS], $X_8$ is H, A, Y, [Tle], [Deg], L or V, $X_9$ is [Nle] or [pl-Phe], $X_{10}$ is P, a D-amino acid, a β-amino acid, a non-canonical amino acid or the D- or β-form of the non-canonical amino acid, and $X_{11}$ is [4-Cl-F], [D-4ClF], [D-Bip] or is absent. In certain embodiments, $X_{10}$ is [D-Tic], [4-Cl-F], [D-4ClF], [Aic], [Oic], [D-4F], [D-Ogl], [f], [1-Nal], [2-Nal], [D-Bip], [Tic], [Aib] or [Deg]. In these and other embodiments, the lipid-peptide conjugate may comprise the sequence of any one of SEQ ID NOs: 121-210 and 245-256.

In another embodiment of the invention, the lipid-apelin peptide conjugate can be described by the following formula: {TDA}[AC4Abu][Aeea][Aeea] $X_1$q[hArg]P[NMeArg][Cha]SHKG[Oic][Nle]$X_2X_3$ (SEQ ID No: 725), wherein: $X_1$ is [hArg] or is absent, $X_2$ is P, a D-amino acid or a non-canonical amino acid, and $X_3$ is a D-amino acid, a non-canonical amino acid or —COOH. In these and other embodiments, the lipid-peptide conjugate may comprise the sequence of any one of SEQ ID NOs: 121-152.

In still another embodiment of the invention, the lipid-apelin peptide conjugate can be described by the following formula: {TDA}[AC4Abu][Aeea][Aeea][hArg]q[hArg]P[NMeArg][Cha]SHKG[Oic][Nle] $X_1$COOH (SEQ ID No. 726), wherein $X_1$ is a D-amino acid, a β-amino acid, a non-canonical amino acid or the D- or β-form of the non-canonical amino acid. In some embodiments, $X_1$ is [D-Tic], [4-CL-F], [D-4ClF], [Aic], [Oic], [D-41F], [D-IgL], [f], [1-Nal], [2-Nal], [D-Bip] or [Tic]. In certain embodiments, the lipid-peptide conjugate may comprise the sequence of any one of SEQ ID NOs: 166, 171, and 245-256.

In one embodiment of the invention, the lipid-apelin peptide conjugate can be described by the following formula: {TDA}[AC4Abu][Aeea][Aeea]Q$X_1$P$X_2X_3$SHKG[Oic]$X_4X_5X_6$ (SEQ ID No: 727), wherein: $X_1$ is R, r or [hArg], $X_2$ is r, [hArg] or [NMeArg], $X_3$ is [NMeLeu] or [Cha], $X_4$ is [pl-Phe] or [Nle], $X_5$ is P or [D-1Nal], and $X_6$ is [D-Bip], [4-CL-F], [D-4ClF] or is absent. In these and other embodiments, the lipid-peptide conjugate may comprise the sequence of any one of SEQ ID NOs: 165 and 211-233.

In yet another embodiment of the invention, the lipid-apelin peptide conjugate can be described by the following formula: {TDA}[AC4Abu][Aeea][Aeea] $X_1X_2X_3PX_4X_5X_6X_7$KG[Oic]$X_8X_9X_{10}$ (SEQ ID No: 728) wherein: $X_1$ is [hArg] or [r], $X_2$ is Q or [q], $X_3$ is r or [hArg], $X_4$ is r or [NMeArg], $X_5$ is [NMeLeu], [BLeu], or [Cha], $X_6$ is S or [bAla], $X_7$ is H, A or [Tle], $X_8$ is [Nle] or [pl-Phe], $X_9$ is P, a D-amino acid, α-amino acid, a non-canonical amino acid or the D- or β-form of the non-canonical amino acid, and $X_{10}$ is [Oic], [4-Cl-F], [D-4ClF], [D-1Nal], [D-Bip] or is absent.

In some embodiments, $X_9$ is [D-Tic], [4-Cl-F] [D-4ClF], [Aic], [Oic], [D-igl], [f], [D-1Nal], [D-2Nal], [1-Nal], [2-Nal] or [D-Bip] and $X_{10}$ is absent. In certain embodiments, the lipid-peptide conjugate may comprise the sequence of any one of SEQ ID NOs: 153-155, 166, 171, 173-175, 180, 199, 201, 208, and 245-256.

Exemplary lipid-apelin peptide conjugates of the invention are provided in Table 7 below. The present invention includes an isolated polypeptide comprising the sequence of any one of the lipid-peptide conjugates listed in Table 7.

TABLE 7

Exemplary Lipid-ApelinPeptide Conjugates

| SEQ ID NO: | SEQUENCE |
|---|---|
| 121 | {TDA}[AC4Abu][Aeea][Aeea][q][hArg]P[NMeArg][Cha]SHKG[Oic][Nle]P [Oic] |
| 122 | {TDA}[AC4Abu][Aeea][Aeea][q][hArg]P[NMeArg][Cha]SHKG[Oic][Nle]P [Aic] |
| 123 | {TDA}[AC4Abu][Aeea][Aeea][q][hArg]P[NMeArg][Cha]SHKG[Oic][Nle]P [D-1Nal] |
| 124 | {TDA}[AC4Abu][Aeea][Aeea][q][hArg]P[NMeArg][Cha]SHKG[Oic][Nle]P [D-2Nal] |
| 125 | {TDA}[AC4Abu][Aeea][Aeea][q][hArg]P[NMeArg][Cha]SHKG[Oic][Nle]P [D-Igl] |
| 126 | {TDA}[AC4Abu][Aeea][Aeea][q][hArg]P[NMeArg][Cha]SHKG[Oic][Nle]P [f]{COOH} |
| 127 | {TDA}[AC4Abu][Aeea][Aeea][q][hArg]P[NMeArg][Cha]SHKG[Oic][Nle]P [D-4ClF] |
| 128 | {TDA}[AC4Abu][Aeea][Aeea][q][hArg]P[NMeArg][Cha]SHKG[Oic][Nle]P [D-Tic] |
| 129 | {TDA}[AC4Abu][Aeea][Aeea][q][hArg]P[NMeArg][Cha]SHKG[Oic][Nle]P [D-4IF] |
| 130 | {TDA}[AC4Abu][Aeea][Aeea][q][hArg]P[NMeArg][Cha]SHKG[Oic][Nle] [D-Tic]{COOH} |
| 131 | {TDA}[AC4Abu][Aeea][Aeea][q][hArg]P[NMeArg][Cha]SHKG[Oic][Nle] [4-Cl-F]{COOH} |
| 132 | {TDA}[AC4Abu][Aeea][Aeea][q][hArg]P[NMeArg][Cha]SHKG[Oic][Nle] [D-4ClF]{COOH} |
| 133 | {TDA}[AC4Abu][Aeea][Aeea][q][hArg]P[NMeArg][Cha]SHKG[Oic][Nle] [Aic]{COOH} |
| 134 | {TDA}[AC4Abu][Aeea][Aeea][q][hArg]P[NMeArg][Cha]SHKG[Oic][Nle] [Oic]{COOH} |
| 135 | {TDA}[AC4Abu][Aeea][Aeea][q][hArg]P[NMeArg][Cha]SHKG[Oic][Nle] [D-4IF]{COOH} |
| 136 | {TDA}[AC4Abu][Aeea][Aeea][q][hArg]P[NMeArg][Cha]SHKG[Oic][Nle] [D-Igl]{COOH} |
| 137 | {TDA}[AC4Abu][Aeea][Aeea][q][hArg]P[NMeArg][Cha]SHKG[Oic][Nle][f] {COOH} |
| 138 | {TDA}[AC4Abu][Aeea][Aeea][q][hArg]P[NMeArg][Cha]SHKG[Oic][Nle] [1-Nal]{COOH} |
| 139 | {TDA}[AC4Abu][Aeea][Aeea][q][hArg]P[NMeArg][Cha]SHKG[Oic][Nle] [2-Nal]{COOH} |
| 140 | {TDA}[AC4Abu][Aeea][Aeea][q][hArg]P[NMeArg][Cha]SHKG[Oic][Nle] [D-1Nal]{COOH} |
| 141 | {TDA}[AC4Abu][Aeea][Aeea][q][hArg]P[NMeArg][Cha]SHKG[Oic][Nle] [D-2Nal]{COOH} |

TABLE 7-continued

| Exemplary Lipid-ApelinPeptide Conjugates | |
|---|---|
| SEQ ID NO: | SEQUENCE |
| 142 | {TDA}[AC4Abu][Aeea][Aeea][q][hArg]P[NMeArg][Cha]SHKG[Oic][Nle][D-Bip]{COOH} |
| 143 | {TDA}[AC4Abu][Acea][Aeea][q][hArg]P[NMeArg][Cha]SHKG[Oic][Nle][Tic]{COOH} |
| 144 | {TDA}[AC4Abu][Aeea][Aeea][hArg][q][hArg]P[NMeArg][Cha]SHKG[Oic][Nle]P[Oic] |
| 145 | {TDA}[AC4Abu][Aeea][Aeea][hArg][q][hArg]P[NMeArg][Cha]SHKG[Oic][Nle]P[Aic] |
| 146 | {TDA}[AC4Abu][Acea][Aeea][hArg][q][hArg]P[NMeArg][Cha]SHKG[Oic][Nle]P[D-1Nal] |
| 147 | {TDA}[AC4Abu][Aeea][Aeea][hArg][q][hArg]P[NMeArg][Cha]SHKG[Oic][Nle]P[D-2Nal] |
| 148 | {TDA}[AC4Abu][Aeea][Acea][hArg][q][hArg]P[NMeArg][Cha]SHKG[Oic][Nle]P[D-Igl] |
| 149 | {TDA}[AC4Abu][Aeea][Aeea][hArg][q][hArg]P[NMeArg][Cha]SHKG[Oic][Nle]P[f] |
| 150 | {TDA}[AC4Abu][Aeea][Aeea][hArg][q][hArg]P[NMeArg][Cha]SHKG[Oic][Nle]P[D-4ClF] |
| 151 | {TDA}[AC4Abu][Aeea][Aeea][hArg][q][hArg]P[NMeArg][Cha]SHKG[Oic][Nle]P[D-Tic] |
| 152 | {TDA}[AC4Abu][Aeea][Aeea][hArg][q][hArg]P[NMeArg][Cha]SHKG[Oic][Nle]P[D-4IF] |
| 153 | {TDA}[AC4Abu][Aeea][Aeea][r]Q[hArg]P[r][NMeLeu]SHKG[Oic][pI-Phe]P[Oic]{COOH} |
| 154 | {TDA}[AC4Abu][Aeea][Aeea][r]Q[hArg]P[r][NMeLeu]SHKG[Oic][pI-Phe]P[D-4ClF]{COOH} |
| 155 | {TDA}[AC4Abu][Aeea][Aeea][r]Q[hArg]P[r][NMeLeu]SHKG[Oic][pI-Phe]P[D-1Nal]{COOH} |
| 156 | {TDA}[AC4Abu][Aeea][Aeea][hArg][q][hArg]P[r][NMeLeu]SHKG[Oic][pI-Phe]P[D-Bip] |
| 157 | {TDA}[AC4Abu][Aeea][Acea][hArg][q][hArg]P[NMeArg][Cha]SHKG[Oic][Nle][Aib][4-Cl-F] |
| 158 | {TDA}[AC4Abu][Aeea][Aeea][hArg][q][hArg]P[NMeArg][Cha]SHKG[Oic][Nle][Deg][4-Cl-F] |
| 159 | {TDA}[AC4Abu][Aeea][Aeea][hArg][q][hArg]P[NMeArg][Cha]SHKG[Oic][Nle][Pip][4-Cl-F] |
| 160 | {TDA}[AC4Abu][Aeea][Aeea][hArg][q][hArg]P[NMeArg][Cha]SHKG[Oic][Nle][Pip][D-4ClF] |
| 161 | {TDA}[AC4Abu][Aeea][Aeea][hArg][q][hArg][Pip][NMeArg][Cha]SHKG[Oic][Nle]P[4-Cl-F] |
| 162 | {TDA}[AC4Abu][Aeea][Aeea][hArg][q][hArg][Pip][NMeArg][Cha]SHKG[Oic][Nle][Pip][4-Cl-F] |
| 163 | {TDA}[AC4Abu][Aeea][Aeea][hArg]Q[hArg]P[hArg][Cha]SHKG[Oic][Nle][D-1Nal] |
| 164 | {TDA}[AC4Abu][Aeea][Aeea][hArg]Q[hArg]P[NMeArg][Cha]SHKG[Oic][Nle][D-1Nal] |
| 165 | {TDA}[AC4Abu][Aeea][Aeea][hArg]Q[r]P[NMeArg][Cha]SHKG[Oic][Nle][D-1Nal]{COOH} |
| 166 | {TDA}[AC4Abu][Aeea][Aeea][hArg][q][hArg]P[NMeArg][Cha]SHKG[Oic][Nle][D-1Nal]{COOH} |

TABLE 7-continued

| Exemplary Lipid-ApelinPeptide Conjugates | |
|---|---|
| SEQ ID NO: | SEQUENCE |
| 167 | {TDA}[AC4Abu][Acea][Aeea][r]Q[hArg]P[NMeArg][Cha]SHKG[Oic][Nle][D-1Nal] |
| 168 | {TDA}[AC4Abu][Acea][Acea][hArg]Q[hArg]P[hArg][Cha]SHKG[Oic][Nle][4-Cl-F] |
| 169 | {TDA}[AC4Abu][Acea][Aeea][hArg]Q[hArg]P[NMeArg][Cha]SHKG[Oic][Nle][4-Cl-F] |
| 170 | {TDA}[AC4Abu][Aeea][Aeea][hArg]Q[r]P[NMeArg][Cha]SHKG[Oic][Nle][4-Cl-F] |
| 171 | {TDA}[AC4Abu][Aeea][Aeea][hArg][q][hArg]P[NMeArg][Cha]SHKG[Oic][Nle][4-Cl-F]{COOH} |
| 172 | {TDA}[AC4Abu][Aeea][Aeea][r]Q[hArg]P[NMeArg][Cha]SHKG[Oic][Nle][4-Cl-F] |
| 173 | {TDA}[AC4Abu][Aeca][Acea][r]Q[hArg]P[r][NMeLeu]SHKG[Oic][pI-Phe][D-Bip] |
| 174 | {TDA}[AC4Abu][Aeea][Aeea][hArg][q][hArg]P[r][NMeLeu]SHKG[Oic][pI-Phe][D-Bip]{COOH} |
| 175 | {TDA}[AC4Abu][Aeea][Aeea][hArg]Q[r]P[r][NMeLeu]SHKG[Oic][pI-Phe][D-Bip]{COOH} |
| 176 | {TDA}[AC4Abu][Aeea][Aeea][hArg][q][hArg]P[r][NMeLeu]SHKG[Oic][pI-Phe]P[D-Bip] |
| 177 | {TDA}[AC4Abu][Aeea][Aeea][hArg]Q[r]P[r][NMeLeu]SHKG[Oic][pI-Phe]P[D-Bip] |
| 178 | {TDA}[AC4Abu][Aeea][Aeea][hArg][q][r]P[r][NMeLeu]SHKG[Oic][pI-Phe]P[D-Bip] |
| 179 | {TDA}[AC4Abu][Aeea][Acea][r]Q[hArg]P[r][BLeu]SHKG[Oic][pI-Phe]P[D-Bip] |
| 180 | {TDA}[AC4Abu][Aeea][Aeea][hArg][q][hArg]P[r][BLeu]SHKG[Oic][pI-Phe]P[D-Bip]{COOH} |
| 181 | {TDA}[AC4Abu][Aeea][Aeea][hArg][q][r]P[r][BLeu]SHKG[Oic][pI-Phe]P[D-Bip] |
| 182 | {TDA}[AC4Abu][Aeea][Aeea][r]Q[hArg]P[r][NMeCha]SHKG[Oic][pI-Phe]P[D-Bip] |
| 183 | {TDA}[AC4Abu][Acea][Aeea][r][BLeu][hArg]P[r][NMeLeu]SHKG[Oic][pI-Phe]P[D-Bip] |
| 184 | {TDA}[AC4Abu][Acea][Aeea][hArg][BLeu][r]P[r][NMeLeu]SHKG[Oic][pI-Phe]P[D-Bip] |
| 185 | {TDA}[AC4Abu][Acea][Aeea][r][BLeu][r]P[r][NMeLeu]SHKG[Oic][pI-Phe]P[D-Bip] |
| 186 | {TDA}[AC4Abu][Aeea][Acea][r][NMeGln][hArg]P[r][NMeLeu]SHKG[Oic][pI-Phe]P[D-Bip] |
| 187 | {TDA}[AC4Abu][Acea][Acea][r][NMeGln][r]P[r][NMeLeu]SHKG[Oic][pI-Phe\|P[D-Bip] |
| 188 | {TDA}[AC4Abu][Aeea][Acea][r]Q[hArg]P[r][NMeLeu]SAKG[Oic][pI-Phe]P[D-Bip] |
| 189 | {TDA}[AC4Abu][Aeea][Aeea][r]Q[hArg]P[r][NMeLeu]SYKG[Oic][pI-Phe]P[D-Bip] |
| 190 | {TDA}[AC4Abu][Aeea][Acea][r]Q[hArg]P[r][NMeLeu]S[Tle]KG[Oic][pI-Phe]P[D-Bip] |
| 191 | {TDA}[AC4Abu][Aeea][Aeea][r]Q[hArg]P[r][NMeLeu]SLKG[Oic][pI-Phe]P[D-Bip] |

TABLE 7-continued

Exemplary Lipid-ApelinPeptide Conjugates

| SEQ ID NO: | SEQUENCE |
|---|---|
| 192 | {TDA}[AC4Abu][Aeea][Aeea][r]Q[hArg]P[r][NMeLeu]SVKG[Oic][pI-Phe]P[D-Bip] |
| 193 | {TDA}[AC4Abu][Aeea][Aeea][r]Q[hArg][Oic][r][NMeLeu]SHKG[Oic][pI-Phe]P[D-Bip] |
| 194 | {TDA}[AC4Abu][Aeea][Aeea][r]Q[hArg][Sar][r][NMeLeu]SHKG[Oic][pI-Phe]P[D-Bip] |
| 195 | {TDA}[AC4Abu][Aeea][Aeea][r]Q[hArg]P[r][NMeLeu][BhSer]HKG[Oic][pI-Phe]P[D-Bip] |
| 196 | {TDA}[AC4Abu][Aeea][Aeea][r]Q[hArg]P[r][NMeLeu][bAla]HKG[Oic][pI-Phe]P[D-Bip] |
| 197 | {TDA}[AC4Abu][Aeea][Aeea][r]Q[hArg]P[r][NMeLeu][NhSerG]HKG[Oic][pI-Phe]P[D-Bip] |
| 198 | {TDA}[AC4Abu][Aeca][Acea][r]Q[hArg]P[r][NMeLeu][aMeS]HKG[Oic][pI-Phe]P[D-Bip] |
| 199 | {TDA}[AC4Abu][Aeea][Acea][hArg][q][hArg]P[r][NMeLeu]SAKG[Oic][pI-Phe]P[D-Bip]{COOH} |
| 200 | {TDA}[AC4Abu][Acca][Aeea][hArg][q][hArg]P[r][NMeLeu]SYKG[Oic][pI-Phe]P[D-Bip] |
| 201 | {TDA}[AC4Abu][Aeea][Aeea][hArg][q][hArg]P[r][NMeLeu]S[Tle]KG[Oic][pI-Phe]P[D-Bip]{COOH} |
| 202 | {TDA}[AC4Abu][Acea][Acea][hArg][q][hArg]P[r][NMeLeu]S[Deg]KG[Oic][pI-Phe]P[D-Bip] |
| 203 | {TDA}[AC4Abu][Aeea][ Aeea][hArg][q][hArg]P[r][NMeLeu]SLKG[Oic][pI-Phe]P[D-Bip] |
| 204 | {TDA}[AC4Abu][Aeca][Aeea][hArg][q][hArg]P[r][NMeLeu]SVKG[Oic][pI-Phe]P[D-Bip] |
| 205 | {TDA}[AC4Abu][Aeea][Aeea][hArg][q][hArg][Oic][r][NMeLeu]SHKG[Oic][pI-Phe]P[D-Bip] |
| 206 | {TDA}[AC4Abu][Aeea][Aeea][hArg][q][hArg][Sar][r][NMeLeu]SHKG[Oic][pI-Phe]P[D-Bip] |
| 207 | {TDA}[AC4Abu][Acea][Acea][hArg][q][hArg]P[r][NMeLeu][BhSer]HKG[Oic][p]-Phe]P[D-Bip] |
| 208 | {TDA}[AC4Abu][Aeea][Acea][hArg][q][hArg]P[r][NMeLeu][bAla]HKG[Oic][pI-Phe]P[D-Bip]{COOH} |
| 209 | {TDA}[AC4Abu][Aeea][Aeea][hArg][q][hArg]P[r][NMeLeu][NhSerG]HKG[Oic][pI-Phe]P[D-Bip] |
| 210 | {TDA}[AC4Abu][Acea][Aeea][hArg][q][hArg]P[r][NMeLeu][aMeS]HKG[Oic][pI-Phe]P[D-Bip] |
| 211 | {TDA}[AC4Abu][Aeea][Aeea]RQRP[r][NMeLeu]SHKG[Oic][pI-Phe]P[D-Bip] |
| 212 | {TDA}[AC4Abu][Aeea][Aeea]RQRP[hArg][NMeLeu]SHKG[Oic][pI-Phe]P[D-Bip]{COOH} |
| 213 | {TDA}[AC4Abu][Aeea][Aeea][r]QRP[hArg][NMeLeu]SHKG[Oic][pI-Phe]P[D-Bip]{COOH} |
| 214 | {TDA}[AC4Abu][Aeea][Aeea]RQRP[hArg][Cha]SHKG[Oic][pI-Phe]P[D-Bip] |
| 215 | {TDA}[AC4Abu][Aeea][Aeea][r]QRP[r][Cha]SHKG[Oic][pI-Phe]P[D-Bip] |
| 216 | {TDA}[AC4Abu][Aeea][Aeea]RQRP[r][Cha]SHKG[Oic][pI-Phe]P[D-Bip] |
| 217 | {TDA}[AC4Abu][Aeea][Aeea][r]QRP[hArg][Cha]SHKG[Oic][pI-Phe]P[D-Bip] |

TABLE 7-continued

Exemplary Lipid-ApelinPeptide Conjugates

| SEQ ID NO: | SEQUENCE |
|---|---|
| 218 | {TDA}[AC4Abu][Acea][Acea][r]Q[hArg]P[r][NMeLeu]SHKG[Oic][Nle]P[4-Cl-F]{COOH} |
| 219 | {TDA}[AC4Abu][Acea][ Aeea][r]Q[hArg]P[r][NMeLeu]SHKG[Oic][pI-Phe]P[4-Cl-F] |
| 220 | {TDA}[AC4Abu][Aeca][Aeea][r]Q[hArg]P[r][NMeLeu]SHKG[Oic][Nle]P[D-Bip] |
| 221 | {TDA}[AC4Abu][Aeea][Aeea][r]Q[hArg]P[r][Cha]SHKG[Oic][Nle]P[4-Cl-F]{COOH} |
| 222 | {TDA}[AC4Abu][Aeea][ Aeea]QRP[hArg][NMeLeu]SHKG[Oic][pI-Phe]P[D-Bip]{COOH} |
| 223 | {TDA}[AC4Abu][Aeea][Aeea]QRP[hArg][Cha]SHKG[Oic][pI-Phe]P[D-Bip] |
| 224 | {TDA}[AC4Abu][Aeea][Aeea]QRP[r][Cha]SHKG[Oic][pI-Phe]P[D-Bip] |
| 225 | {TDA}[AC4Abu][Aeea][Aeea]Q[hArg]P[r][NMeLeu]SHKG[Oic][Nle]P[4-Cl-F] |
| 226 | {TDA}[AC4Abu][Aeea][Aeea]Q[hArg]P[r][NMeLeu]SHKG[Oic][pI-Phe]P[4-Cl-F] |
| 227 | {TDA}[AC4Abu][Aeea][Aeea]Q[hArg]P[r][NMeLeu]SHKG[Oic][Nle]P[D-Bip] |
| 228 | {TDA}[AC4Abu][Aeca][Aeea]Q[hArg]P[r][Cha]SHKG[Oic][Nle]P[4-Cl-F]{COOH} |
| 229 | {TDA}[AC4Abu][Aeea][Aeea][hArg]Q[r]P[NMeArg][Cha]SHKG[Oic][Nle]P[4-Cl-F]{COOH} |
| 230 | {TDA}[AC4Abu][Aeea][Aeea][hArg]Q[r]P[NMeArg][Cha]SHKG[Oic][Nle]P[D-4ClF]{COOH} |
| 231 | {TDA}[AC4Abu][Aeea][Aeea][Aeea]Q[r]P[NMeArg][Cha]SHKG[Oic][Nle]P[4-Cl-F]{COOH} |
| 232 | {TDA}[AC4Abu][Aeea][Aeea][Aeea]Q[r]P[NMeArg][Cha]SHKG[Oic][Nle]P[D-4ClF]{COOH} |
| 233 | {TDA}[AC4Abu][Aeea][Aeea][Aeea]Q[r]P[NMeArg][Cha]SHKG[Oic][Nle][D-1Nal]{COOH} |
| 234 | {HDA}[AC4Abu][Aeea][Aeea]Q[r]P[NMeArg][Cha]SHKG[Oic][Nle][Pip][4-Cl-F]{COOH} |
| 235 | {HDA}[AC4Abu][Aeea][Aeea][q][hArg]P[r][NMeLeu]SHKG[Oic][Nle]P[f]{COOH} |
| 236 | {HDA}[AC4Abu][Aeea][Aeea][q][hArg]P[NMeArg][Cha]SHKG[Oic][Nle]P4-Cl-F]{COOH} |
| 237 | {HDA}[AC4Abu][Aeea][Aeea][q][hArg]P[NMeArg][Cha]SHKG[Oic][Nle]P[D-4ClF]{COOH} |
| 238 | {HDA}[AC4Abu][Aeea][Acea]Q[r]P[NMeArg][Cha]SHKG[Oic][Nle]P[Tic]{COOH} |
| 239 | {HDA}[AC4Abu][Aeea][Acea][hArg]Q[r]P[NMeArg][Cha]SHKG[Oic][Nle][Pip][4-Cl-F]{COOH} |
| 240 | {HDA}[AC4Abu][Aeea][Aeea][hArg][q][hArg]P[r][NMeLeu]SHKG[Oic][Nle]P[f]{COOH} |
| 241 | {HDA}[AC4Abu][Aeea][Aeea][hArg][q][hArg]P[NMeArg][Cha]SHKG[Oic][Nle]P[4-Cl-F]{COOH} |
| 242 | {HDA}[AC4Abu][Aeea][Aeea][hArg][q][hArg]P[NMeArg][Cha]SHKG[Oic]\|Nle]P[D-4ClF]{COOH} |

TABLE 7-continued

| Exemplary Lipid-ApelinPeptide Conjugates | |
|---|---|
| SEQ ID NO: | SEQUENCE |
| 243 | {HDA}[AC4Abu][Aeea][Aeea][hArg]Q[r]P[NMeArg][Cha]SHKG[Oic][Nle]P[Tic]{COOH} |
| 244 | {TDA}[AC4Abu][Aeea][Aeea]Q[r]P[NMeArg][Cha]SHKG[Oic][Nle]P[Tic]{COOH} |
| 245 | {TDA}[AC4Abu][Aeea][Acea][hArg][q][hArg]P[NMeArg][Cha]SHKG[Oic][Nle][D-Tic]{COOH} |
| 246 | {TDA}[AC4Abu][Aeea][Aeea][hArg][q][hArg]P[NMeArg][Cha]SHKG[Oic][Nle][D-4ClF]{COOH} |
| 247 | {TDA}[AC4Abu][Aeea][Aeea][hArg][q][hArg]P[NMeArg][Cha]SHKG[Oic]Nle][Aic]{COOH} |
| 248 | {TDA}[AC4Abu][Aeea][Aeea][hArg][q][hArg]P[NMeArg][Cha]SHKG[Oic][Nle][Oic]{COOH} |
| 249 | {TDA}[AC4Abu][Aeea][Aeea][hArg][q][hArg]P[NMeArg][Cha]SHKG[Oic][Nle]\|D-4IF]{COOH} |
| 250 | {TDA}[AC4Abu][Aeea][Aeea][hArg][q][hArg]P[NMeArg][Cha]SHKG[Oic]Nle][D-Ig]]{COOH} |
| 251 | {TDA}[AC4Abu][Aeea][Aeea][hArg][q][hArg]P[NMeArg][Cha]SHKG[Oic][Nle][f]{COOH} |
| 252 | {TDA}[AC4Abu][Aeea][Aeea][hArg][q][hArg]P[NMeArg][Cha]SHKG[Oic][Nle][1-Nal]{COOH} |
| 253 | {TDA}[AC4Abu][Aeea][Acea][hArg][q][hArg]P[NMeArg][Cha]SHKG[Oic][Nle][2-Nal]{COOH} |
| 254 | {TDA}[AC4Abu][Aeea][Aeea][hArg][q][hArg]P[NMeArg][Cha]SHKG[Oic][Nle][D-2Nal]{COOH} |
| 255 | {TDA}[AC4Abu][Aeea][Aeea][hArg][q][hArg]P[NMeArg][Cha]SHKG[Oic][Nle][D-Bip]{COOH} |
| 256 | {TDA}[AC4Abu][Aeea][Aeea][hArg][q][hArg]P[NMeArg][Cha]SHKG[Oic][Nle]\|Tic]{COOH} |
| 257 | {TDA}[AC4Abu][Aeea][Acea]OF[hArg][hArg]QRP[hArg][NMeLeu]SHKG[Oic]\|Nle]\|2Nal]{COOH} |
| 258 | {PDA}[AC4Abu][Aeea][Aeea]OF[hArg][hArg]QRP[hArg][NMeLeu]SHKG[Oic]\|Nle][2Nal]{COOH} |
| 259 | {HDA}[AC4Abu][Acea][Aeea]OF[hArg][hArg]QRP[hArg][NMeLeu]SHKG[Oic][Nle]\|2Nal]{COOH} |
| 260 | {ODDA}[AC4Abu][Aeea][Acea]OF[hArg][hArg]QRP[hArg][NMeLeu]SHKG[Oic][Nle][2Nal]{COOH} |
| 261 | {TDA}[AC4Abu][Aeea][Aeea][hArg]rQ[hArg]Pr[NMeLeu]SHKG[Oic][pI-Phe]P[D-Bip]{COOH} |
| 262 | {PDA}[AC4Abu][Aeea][Acea][hArg]rQ[hArg]Pr[NMeLeu]SHKG[Oic][pI-Phe]P[D-Bip]{COOH} |
| 263 | {HDA}[AC4Abu][Aeea][Aeea][hArg]rQ[hArg]Pr[NMeLeu]SHKG[Oic][pI-Phe]P[D-Bip]{COOH} |
| 264 | {ODDA}[AC4Abu][Acea][Aeea][hArg]rQ[hArg]Pr[NMeLeu]SHKG[Oic][pI-Phe]P[D-Bip]{COOH} |
| 265 | {TDA}[AC4Abu][Aeea][Aeea]q[hArg]Pr[Cha]SHKG[Oic][Nle]P[D-4ClF]{COOH} |
| 266 | {TDA}[AC4Abu][Aeea][Aeea]QrPr[Cha]SHKG[Oic][Nle]P[D-4ClF]{COOH} |
| 267 | {TDA}[AC4Abu][Aeea][Aeea]QrP[NMeArg][Cha]SHKG[Oic][Nle]P[4-Cl-F]{COOH} |

TABLE 7-continued

Exemplary Lipid-ApelinPeptide Conjugates

| SEQ ID NO: | SEQUENCE |
|---|---|
| 268 | {TDA}[AC4Abu][Acea][ Acea]q[hArg]Pr[Cha]SHKG[Oic][Nle]P[D-1Nal]{COOH} |
| 269 | {TDA}[AC4Abu][Aeea][Aeea]q[hArg]Pr[Cha]SHKG[Oic][Nle]P[D-Tic]{COOH} |
| 270 | {TDA}[AC4Abu][Aeea][Aeea]q[hArg]Pr[Cha]SHKG[Oic][Nle][Aib][4-Cl-F]{COOH} |
| 271 | {TDA}[AC4Abu][Aeea][Aceea]q[hArg]Pr[Cha]SHKG[Oic][Nle][Deg][4-Cl-F]{COOH} |
| 272 | {TDA}[AC4Abu][Aeea][Aeea]q[hArg]Pr[Cha]SHKG[Oic][Tle]P[4-Cl-F]{COOH} |
| 273 | {TDA}[AC4Abu][Aeea][Aeea]q[hArg]Pr[Cha]S[Aib]KG[Oic][Nle]P[4-Cl-F]{COOH} |
| 274 | {TDA}[AC4Abu][Aeea][Aeea]q[hArg]Pr[BLeu]SHKG[Oic][Nle]P[4-Cl-F]{COOH} |
| 275 | {TDA}[AC4Abu][Aeea][Aeea]q[hArg]P[NMeArg][BLeu]SHKG[Oic][Nle]P[4-Cl-F]{COOH} |
| 276 | {TDA}[AC4Abu][Acea][Acea]q[hArg]Pr[NMeCha]SHKG[Oic][Nle]P[4-Cl-F}{COOH} |
| 277 | {TDA}[AC4Abu][Aeca][Acea]l[hArg]Pr[Cha]SHKG[Oic][Nle]P[4-Cl-F]{COOH} |
| 278 | {TDA}[AC4Abu][Aeea][Aeea][BLeu][hArg]Pr[Cha]SHKG[Oic][Nle]P[4-Cl-F]{COOH} |
| 279 | {TDA}[AC4Abu][Aeea][Aeea]Q[NMeArg]Pr[Cha]SHKG[Oic][Nle]P[4-Cl-F]{COOH} |
| 280 | {TDA}[AC4Abu][Aceea][Acea]q[NMeArg]Pr[Cha]SHKG[Oic][Nle]P[4-Cl-F]{COOH} |
| 281 | {TDA}[AC4Abu][Aeea][Aeea] q[hArg]Pr[BLeu]SHKG[Oic][Nle]P[D-4ClF]{COOH} |
| 282 | {TDA}[AC4Abu][Aeea][Aeea]q[hArg]Pr[Cha]SHKG[Oic][Nle][4-Cl-F]{COOH} |
| 283 | {TDA}[AC4Abu][Aeea][Aeea]q[hArg]Pr[Cha]SHKG[Oic][Nle][D-4ClF]{COOH} |
| 284 | {TDA}[AC4Abu][Acea][Acea]QrP[NMeArg][Cha]SHKG[Oic][Nle]P[D-4ClF]{COOH} |
| 285 | {TDA}[AC4Abu][Aeea][Acea]QrP[NMeArg][Cha]SHKG[Oic][Nle][D-1Nal]{COOH} |
| 286 | {hexanoyl}[AC4Abu][Aeea][Aeea][hArg]rQ[hArg]Pr[NMeLeu] SHKG[Oic][pI-Phe]P[D-Bip]{COOH} |
| 287 | {TDA}[AC4Abu][Aeea][Aeea]QRP[NMeArg]LSHKGP[Nle]P[4-Cl-F]{COOH} |
| 288 | {Sebacicacid}[AC4Abu][Aeea][Aeea]Q[hArg]Pr[NMeLeu]SHKG[Oic][pI-Phe]P[D-Bip]{COOH} |
| 289 | {Sebacicacid}[AC4Abu][Aeea][Acea][hArg]rQ[hArg]Pr[NMeLeu]SHKG[Oic][pI-Phe]P[D-Bip]{COOH} |
| 290 | {ODDA}[AC4Abu][Aeea][Aeea]QRPRLSHKGPMPF{COOH} |
| 291 | {Sebacicacid}[AC4Abu][Aeea][Aeea][hArg]rQ[hArg]Pr[NMeLeu]SHKG[Oic][pI-Phe]P[D-Bip]{COOH} |
| 292 | {TDA}[AC4Abu][Aeea][Aeea]l[hArg]P[NMeArg][Cha]SHKG[Oic][Nle]P[D-4ClF]{COOH} |
| 293 | {TDA}[AC4Abu][Aeea][Aeea]q[hArg]P[NMeArg][Cha]SH[bAla]G[Oic][Nle]P[D-4ClF]{COOH} |

TABLE 7-continued

| Exemplary Lipid-ApelinPeptide Conjugates | |
|---|---|
| SEQ ID NO: | SEQUENCE |
| 294 | {TDA}[AC4Abu][Aeea][Aeea]q[hArg]P[NMeArg][Cha]SHK[bAla][Oic][Nle]P[D-4ClF]{COOH} |
| 295 | {TDA}[AC4Abu][Aeea][Acea]q[hArg]P[NMeArg][Cha]SHKG[Oic][Nle][bAla]\| D-4ClF]{COOH} |
| 296 | {TDA}[AC4Abu][Aeea][Aeea]q[hArg]P[NMeArg][Cha]SHKG[Oic][Nle][BhPro][D-4ClF]{COOH} |
| 297 | {TDA}[AC4Abu][Aeea][Aeea]OF[hArg][hArg]Q[NMeArg]P[NMeArg][Cha]SHKG[Oic][Nle]P[4-Cl-F]{COOH} |
| 298 | {TDA}[AC4Abu][Acea][Aeea][BLeu][hArg]P[NMeArg][Cha]SHKG[Oic][Nle]P[D-4ClF]{COOH} |
| 299 | {TDA}[AC4Abu][Aeea][Aeea][BhAsn][hArg]P[NMeArg][Cha]SHKG[Oic][Nle]P[D-4ClF]{COOH} |
| 300 | {TDA}[AC4Abu][Aeea][Aeca][BhLeu][hArg]P[NMeArg][Cha]SHKG[Oic][Nle]P[D-4ClF]{COOH} |
| 301 | {TDA}[AC4Abu][Aeea][Aeea]q[hArg][BhPro][NMeArg][Cha]SHKG[Oic][Nle]P[D-4ClF]{COOH} |
| 302 | {TDA}[AC4Abu][Aeea][ Aeea]q[hArg]P[NMeArg][BhLeu]SHKG[Oic][Nle]P[D-4ClF]{COOH} |
| 303 | {TDA}[AC4Abu][Aeea][Aeea]q[hArg]P[NMeArg][Cha][bAla]HKG[Oic][Nle]P[D-4ClF]{COOH} |
| 304 | {TDA}[AC4Abu][Aeea][Aeea]q[hArg]P[NMeArg][Cha]S[bAla]KG[Oic][Nle]P[D-4ClF]{COOH} |
| 305 | {TDA}[AC4Abu][Aeca][Aeea]q[hArg]P[NMeArg][Cha]SH[3Pal]G[Oic][Nle]P[D-4ClF]{COOH} |
| 306 | {TDA}[AC4Abu][Acea][Acea]q[hArg]P[NMeArg][Cha]SH[BLys]G[Oic][Nle]P[D-4ClF]{COOH} |
| 307 | {TDA}[AC4Abu][Aeea][Aeea]OF[hArg][hArg][BLeu][hArg]P[hArg][Cha]SHKG[Oic][Nle]P[4-Cl-F]{COOH} |
| 308 | {TDA}[AC4Abu][Aeea][Aeea]QRP[hArg][Cha]SHKG[Oic][Nle]P[4-Cl-F]{COOH} |
| 309 | {TDA}[AC4Abu][Aeea][Aeea][hArg][hArg]Q[hArg]P[NMeArg][Cha]SHKG[Oic][Nle]P[4-Cl-F]{COOH} |
| 310 | {TDA}[AC4Abu][Aeea][Acea][hArg]Q[hArg]P[NMeArg][Cha]SHKG[Oic][Nle]P[4-Cl-F]{COOH} |
| 311 | {TDA}[AC4Abu][Aeea][Acea][hArg]rQ[hArg]P[Nle][NMeLeu]SHKG[Oic][pI-Phe]P[D-Bip]{COOH} |
| 312 | {TDA}[AC4Abu][Aeea][Acea][hArg]rQ[hArg]Pr[NMeLeu]SH[Nle]G[Oic][pI-Phe]P[D-Bip]{COOH} |
| 313 | {TDA}[AC4Abu][Aeea][Aeea][hArg]rQ[hArg]PK[NMeLeu]SH[Nle]G[Oic][pI-Phe]P[D-Bip]{COOH} |
| 314 | {TDA}[AC4Abu][Aeea][Aeea][Nle]rQ[hArg]Pr[NMeLeu]SHKG[Oic][pI-Phe]P[D-Bip]{COOH} |
| 315 | {TDA}[AC4Abu][Acea][Acea][hArg][Nle]Q[hArg]Pr[NMeLeu]SHKG[Oic][pI-Phe]P[D-Bip]{COOH} |
| 316 | {TDA}[AC4Abu][Aeea][Aeea][hArg]rQ[Nle]Pr[NMeLeu]SHKG[Oic][pI-Phe]P[D-Bip]{COOH} |
| 317 | {TDA}[AC4Abu][Aeea][Aeea][hArg]rQ[hArg]P[Nle][NMeLeu]AHKG[Oic][pI-Phe]P[D-Bip]{COOH} |
| 318 | {TDA}[AC4Abu][Aeea][Acea][hArg]rQ[hArg]Pr[NMeLeu]AH[Nle]G[Oic][pI-Phe]P[D-Bip]{COOH} |

TABLE 7-continued

| Exemplary Lipid-ApelinPeptide Conjugates | |
|---|---|
| SEQ ID NO: | SEQUENCE |
| 319 | {TDA}[AC4Abu][Aeea][ Acea][hArg]rQ[hArg]PK[NMeLeu] AH[Nle]G[Oic][pI-Phe]P[D-Bip]{COOH} |
| 320 | {TDA}[AC4Abu][Aeea][Aeea][Nle]rQ[hArg]Pr[NMeLeu] AHKG[Oic][pI-Phe]P[D-Bip]{COOH} |
| 321 | {TDA}[AC4Abu][Aeea][Acea][hArg][Nle]Q[hArg]Pr[NMeLeu]AHKG[Oic][pI-Phe]P[D-Bip]{COOH} |
| 322 | {TDA}[AC4Abu][Aeea][Aeea][hArg]rQ[Nle]Pr[NMeLeu] AHKG[Oic][pI-Phe]P[D-Bip]{COOH} |
| 323 | {TDA}[AC4Abu][Aeea][Aeea][hArg]rQ[hArg]P[Nle][NMeLeu]SAKG[Oic][pI-Phe]P[D-Bip]{COOH} |
| 324 | {TDA}[AC4Abu][Aeea][Acea][hArg]rQ[hArg]Pr[NMeLeu]SA[Nle]G[Oic][pI-Phe]P[D-Bip]{COOH} |
| 325 | {TDA}[AC4Abu][Aeea][Aeea][hArg]rQ[hArg]PK[NMeLeu]SA[Nle]G[Oic][pI-Phe]P[D-Bip]{COOH} |
| 326 | {TDA}[AC4Abu][Aeea][Aeea][Nle]rQ[hArg]Pr[NMeLeu]SAKG[Oic][pI-Phe]P[D-Bip]{COOH} |
| 327 | {TDA}[AC4Abu][Aeea][Aeea][hArg][Nle]Q[hArg]Pr[NMeLeu]SAKG[Oic][pI-Phe]P[D-Bip]{COOH} |
| 328 | {TDA}[AC4Abu][Aeea][Aeea][hArg]rQ[Nle]Pr[NMeLeu]SAKG[Oic][pI-Phe]P[D-Bip]{COOH} |
| 329 | {TDA}[AC4Abu][Aeea][Aeea][hArg]Q[hArg]P[Nle][NMeLeu]AAKG[Oic][pI-Phe]P[D-Bip]{COOH} |
| 330 | {TDA}[AC4Abu][Aeea][Aeea][hArg]rQ[hArg]Pr[NMeLeu]AA[Nle]G[Oic][pI-Phe]P[D-Bip]{COOH} |
| 331 | {TDA}[AC4Abu][Aeea][Aeea][hArg]rQ[hArg]PK[NMeLeu]AA[Nle]G[Oic][pI-Phe]P[D-Bip]{COOH} |
| 332 | {TDA}[AC4Abu][Aeea][Aeea][Nle]rQ[hArg]Pr[NMeLeu] AAKG[Oic][pI-Phe]P[D-Bip]{COOH} |
| 333 | {TDA}[AC4Abu][Aeea][Acea][hArg][Nle]Q[hArg]Pr[NMeLeu]AAKG[Oic][pI-Phe]P[D-Bip]{COOH} |
| 334 | {TDA}[AC4Abu][Aeea][Aeea][hArg]rQ[Nle]Pr[NMeLeu]AAKG[Oic][pI-Phe]P[D-Bip]{COOH} |
| 335 | {TDA}[AC4Abu][Aeea][Aeea]RQRP[Nle][Cha]SHKG[Oic][Nle]P[4-Cl-F]{COOH} |
| 336 | {TDA}[AC4Abu][Aeea][Aeea]RQRP[hArg][Cha]SH[Nle]G[Oic][Nle]P[4-Cl-F]{COOH} |
| 337 | {TDA}[AC4Abu][Aeea][Aeea]RQRPK[Cha]SH[Nle]G[Oic][Nle]P[4-Cl-F]{COOH} |
| 338 | {TDA}[AC4Abu][Aeea][Aeea][Nle] Q R P [hArg] [Cha] SH K G [Oic][Nle] P [4-Cl-F] {COOH} |
| 339 | {TDA}[AC4Abu][Aeea][Aeea] R Q [Nle] P [hArg][Cha] S H K G [Oic][Nle] P [4-Cl-F] {COOH} |
| 340 | {TDA}[AC4Abu][Aeea][Aeea] R Q R P [hArg] [Cha] S A [Nle] G [Oic][Nle] P [4-Cl-F] {COOH} |
| 341 | {TDA}[AC4Abu][Aeea][Aeea] R Q R P K [Cha] S A [Nle] G [Oic] [Nle] P[4-Cl-F] {COOH} |
| 342 | {TDA}[AC4Abu][Aeea][Aeea][Nle] Q R P [hArg] [Cha] S A K G [Oic][Nle] P [4-Cl-F] {COOH} |
| 343 | {TDA}[AC4Abu][Aeea][Aeea] R Q [Nle] P [hArg] [Cha] S A K G [Oic][Nle] P [4-Cl-F] {COOH} |

TABLE 7-continued

| Exemplary Lipid-ApelinPeptide Conjugates | |
|---|---|
| SEQ ID NO: | SEQUENCE |
| 344 | {TDA}[AC4Abu][Aeea][Aeea] R Q R P [Nle] [Cha] A H K G [Oic] [Nle] P [4-Cl-F] {COOH} |
| 345 | {TDA}[AC4Abu][Aeea][Aeea] R Q R P [Nle][Cha] A A K G [Oic] [Nle] P [4-Cl-F] {COOH} |
| 346 | {TDA}[AC4Abu][Aeea][Aeea] R Q R P K [Cha] A A [Nle] G [Oic] [Nle] P [4-Cl-F] {COOH} |
| 347 | {TDA}[AC4Abu][Aeea][Aeea][Nle] Q R P [hArg] [Cha] A A K G [Oic] [Nle] P [4-Cl-F] {COOH} |
| 348 | {TDA} [AC4Abu] [Aeea] [Aeea] R Q [Nle] P [hArg] [Cha] A A K G [Oic] [Nle] P [4-Cl-F] {COOH} |
| 349 | {DDDA} [AC4Abu] [Aeea] [Aeea] Q [hArg] P r [NMeLeu] S H K G [Oic] [pI-Phe] P [D-Bip] {COOH} |
| 350 | {TDA} [AC4Abu] [Aeea][Aeea] R Q R P [Nle] [Cha] S A K G [Oic] [Nle] P [4-Cl-F] {COOH} |
| 351 | {TDA} [AC4Abu] [Acea] [Acea] R Q R P [hArg] [Cha] A A [Nle] G [Oic] [Nle] P [4-Cl-F] {COOH} |
| 352 | {TDA} [AC4Abu] [Aeea] [Aeea] Q R P [NMeArg] L S H K G [Oic] [Nle] P [4-Cl-F] {COOH} |
| 353 | {TDA} [AC4Abu] [Aeea] [Aeea] Q [hArg] P [NMeArg] L S H K G P [Nle] P [4-Cl-F] {COOH} |
| 354 | {TDA} [AC4Abu] [Aeea] [Acea] Q [hArg] P [NMeArg] L S H K G[ Oic] [Nle] P [4-Cl-F] {COOH} |
| 355 | {TDA} [AC4Abu] [Aeea] [Aeea] Q R P [hArg] L S H K G P [Nle] P [4-Cl-F] {COOH} |
| 356 | {TDA} [AC4Abu] [Acea] [Aeea] Q R P [hArg] L S H K G [Oic] [Nle] P [4-Cl-F] {COOH} |
| 357 | {TDA} [AC4Abu] [Acea] [Aeea] Q [hArg] P [hArg] L S H K G P [Nle] P [4-Cl-F] {COOH} |
| 358 | {TDA} [AC4Abu] [Aeea] [Aeea] Q [hArg] P [hArg] L S H K G [Oic] [Nle] P [4-Cl-F] {COOH} |
| 359 | {TDA} [AC4Abu] [Aeca] [Acea] Q [hArg] P [NMeArg] [aMeLeu] S H K G [Oic] [Nle] P [4-Cl-F] {COOH} |
| 360 | {TDA} [AC4Abu] [Acea] [Acea] Q R P [hArg] [aMeLeu] S H K G [Oic] [Nle] P [4-Cl-F] {COOH} |
| 361 | {TDA} [AC4Abu] [Aeea] [Aeea] Q R P [NMeArg] [Cha] S H K G P [Nle] P [4-Cl-F] {COOH} |
| 362 | {TDA} [AC4Abu] [Aeea] [Aeea] Q [hArg] P [NMeArg] [Cha] S H K G [Oic] [Nle] P [4-Cl-F] {COOH} |
| 363 | {TDA} [AC4Abu] [Aeea] [Aeea] q [hArg] P r [Cha] S H K G [Oic] [Nle] P [4-Cl-F] {COOH} |
| 364 | {TDA} [AC4Abu] [Aeea] [Aeea] Q [hArg] P r [Cha] S H K G [Oic] [Nle] P [D-4ClF] {COOH} |
| 365 | {TDA} [AC4Abu] [Aeea] [Aeea] q [hArg] P r [Cha] S H K G [Oic] [Nle] P [Oic] {COOH} |
| 366 | {TDA} [AC4Abu] [Aeea] [Aeea] q [hArg] P r [Cha] S H K G [Oic] [Nle] P [Aic] {COOH} |
| 367 | {TDA} [AC4Abu] [Aeea] [Aeea] q [hArg] P r [Cha] S H K G [Oic] [Nle] P [1-Nal] {COOH} |
| 368 | {TDA} [AC4Abu] [Aeea] [Aeea] q [hArg] P r [Cha] S H K G [Oic] [Nle] P [2-Nal] {COOH} |

TABLE 7-continued

| Exemplary Lipid-ApelinPeptide Conjugates | |
|---|---|
| SEQ ID NO: | SEQUENCE |
| 369 | {TDA} [AC4Abu][Aeea] [Aeea] q [hArg] P r [Cha] S H K G [Oic] [Nle] P [D-4IF] {COOH} |
| 370 | {TDA} [AC4Abu] [Aeea] [Aeea] q [hArg] P r [Cha] S H K G [Oic] [Nle] P [Bh4ClF] {COOH} |
| 371 | {TDA} [AC4Abu] [Aeea] [Aeea] q [hArg] P r [Cha] S H K [Tle] [Oic] [Nle] P [4-Cl-F]{COOH} |
| 372 | {TDA} [AC4Abu] [Aeea] [Aeea] q [hArg] P r [Cha] S A K G [Oic] [Nle] P [4-Cl-F] {COOH} |
| 373 | {TDA} [AC4Abu] [Aeea] [Aeea] q [hArg] P r [Cha] S Y K G [Oic] [Nle] P 4-Cl-F] {COOH} |
| 374 | {TDA} [AC4Abu] [Acea] [Acea] [BLeu] R P [NMeArg] [aMeLeu] S H K G [Oic] [Nle] P [4-Cl-F] {COOH} |
| 375 | {TDA} [AC4Abu] [Aeea] [Aeea] [aMeLeu] R P [NMeArg] [aMeLeu] S H K G [Oic] [Nle] P [4-Cl-F] {COOH} |
| 376 | {TDA} [AC4Abu] [Aeea] [Aeea] Q R P [NMeArg] [aMeLeu] S H K G [Oic] [Nle] [aMePro] [4-Cl-F] {COOH} |
| 377 | {TDA} [AC4Abu] [Aeea] [Aeea] q R P [NMeArg] [Cha] S H K G [Oic] [Nle] P [4-Cl-F] {COOH} |
| 378 | {TDA} [AC4Abu] [Aeea] [Aeea] q R P [hArg] [BLeu] S H K G [Oic] [Nle] P [4-Cl-F] {COOH} |
| 379 | {TDA} [AC4Abu] [Aeea] [Aeea] Q R P [NMeArg] [Cha] S H K G [Oic] [Nle] P [BhPhe] {COOH} |
| 380 | {TDA} [AC4Abu] [Aeea] [Aeea] Q R P [NMeArg] [Cha] S H K G [Oic] [Nle] P [D-BhPhe] {COOH} |
| 381 | {TDA} [AC4Abu] [Aeea] [Aeea] Q R P [NMeArg] [Cha] S H K G [Oic] [Nle] P [D-4ClF] {COOH} |
| 382 | {TDA} [AC4Abu] [Aeea] [Aeea] Q R P [NMeArg] [Cha] S H K G [Oic] [Nle] [Aib] [4-Cl-F] {COOH} |
| 383 | {TDA} [AC4Abu] [Aeea] [Aeea] Q [hArg] P [NMeArg] [BLeu] S H K G P [Nle] P [4-Cl-F] {COOH} |
| 384 | {TDA} [AC4Abu] [Aeea] [Aeea] Q rP [NMehArg] [BLeu] S H K G P [Nle] P [4-Cl-F] {COOH} |
| 385 | {TDA} [AC4Abu] [Aeea] [Aeea] Q R P [NMeArg] [aMeLeu] S H K G [Oic] [Nle] P [4-Cl-F] {COOH} |
| 386 | {TDA} [AC4Abu] [Aeca] [Aeea] q R P [NMeArg] [aMeLeu] S H K G [Oic] [Nle] P [4-Cl-F] {COOH} |
| 387 | {TDA} [AC4Abu] [Aeea] [Aeea] Q R P [NMeArg] [aMeLeu] S H K G [aMePro] [Nle] P [4-Cl-F]{COOH} |
| 388 | {TDA} [AC4Abu] [Aeea] [Aeea] [BLeu] R P [NMeArg] [aMeLeu] S H K G [Oic] [Nle] [aMePro] [4-Cl-F] {COOH} |
| 389 | {TDA} [AC4Abu] [Aeea] [Aeea] Q R P [NMeArg] [aMeLeu] S H K G [Oic] [Nle] [4-Cl-F] {COOH} |
| 390 | {TDA} [AC4Abu] [Aeea] [Aeea] Q R P [NMeArg] [Cha] S H K G [Oic] [Nle] P [4-Cl-F] {COOH} |
| 391 | {TDA} [AC4Abu] [Aeea] [Aeea] Q R P [NMeArg] [BLeu] S H K G [Oic] [Nle] P [4-Cl-F] {COOH} |
| 392 | {TDA} [AC4Abu] [Aeea] [Aeea] Q R[aMePro] [hArg] [BLeu] S H K G [Oic] [Nle]P [4-Cl-F] {COOH} |
| 393 | {TDA} [AC4Abu] [Aeea] [Aeea] [BLeu] R P [NMeArg] [Cha] S H K G [Oic] [Nle]P [4-Cl-F] {COOH} |

TABLE 7-continued

| Exemplary Lipid-ApelinPeptide Conjugates | |
|---|---|
| SEQ ID NO: | SEQUENCE |
| 394 | {TDA} [AC4Abu] [Aeea] [Aeea] [BLeu] R P [NMeArg] [BLeu] S H K G [Oic] [Nle]P [4-Cl-F] {COOH} |
| 395 | {TDA} [AC4Abu] [Aeea] [Aeea] [BLeu] R P [hArg] [BLeu] S H K G [Oic] [Nle] P [4-Cl-F] {COOH} |
| 396 | {TDA} [AC4Abu] [Aeea] [Acea] Q R[NMeArg] [aMeLeu] S H K G [Oic] [Nle] P [4-Cl-F] {COOH} |
| 397 | {TDA} [AC4Abu] [Aeea] [Aeea] Q [NMeArg] [aMeLeu] S H K G [Oic] [Nle] P [4-Cl-F] {COOH} |
| 398 | {TDA} [AC4Abu] [Aeea] [Aeea] [Aeea] [Aeea] [Aeea] [Aeea] Q R P INMeArg] L S H K G P [Nle]P [4-Cl-F] {COOH} |
| 399 | {TDA} [AC4Abu] [AC4Abu] [Aeea] [Acea] Q R P [NMeArg] L S H K G P [Nle]P [4-Cl-F] {COOH} |
| 400 | {TDA} [AC4Abu] [Aeea] [Aeea] Q [Cit] P [NMeArg] L S H K GP [Nle] P [4-Cl-F] {COOH} |
| 401 | {TDA} [AC4Abu] [Aeea] [Aeea] Q R P [NMeArg] L S H K G P [Nle] [aMePro] [4-Cl-F] {COOH} |
| 402 | {TDA} [AC4Abu] [Aeea] [Aeea] Q R P [NMeArg] L S H K G P [Nle] [4-Cl-F] {COOH} |
| 403 | {TDA} [AC4Abu] [Aeea] [Aeea] Q R P [NMeArg] L S H K G P [Nle] [2Nal] {COOH} |
| 404 | {TDA} [AC4Abu] [Aeea] [Aeea] Q R P [hArg] [aMeLeu] S H K G P [Nle]P [2Nal] {COOH} |
| 405 | {TDA} [AC4Abu] [Acea] [Acea] Q [hArg]P [NMeArg] [Cha] S H K G [Oic] [Nle] P [2Nal] {COOH} |
| 406 | {TDA} [AC4Abu] [Aeea] [Aeea] q [hArg] P r [Cha] S H K G [Oic] [Nle]P [CPG] {COOH} |
| 407 | {TDA} [AC4Abu] [Aeea] [Aeea] q [hArg] P r [Cha] S H K G [Oic] [Nle]P [D-2Nal] {COOH} |
| 408 | {TDA} [AC4Abu] [Aeea] [Aeea] Q [hArg] P [NMeArg] [Cha] S H K GP [Nle]P [4-Cl-F] {COOH} |
| 409 | {TDA} [AC4Abu] [Aeea] [Aceea] Q R P [NMeArg] [Cha] S H K G [Oic] [Nle] [4-Cl-F] {COOH} |
| 410 | {TDA} [AC4Abu] [Acea] [Aeea] Q R P [NMeArg] [Cha] S H K G [Oic] [Nle] [D-4ClF] {COOH} |
| 411 | {TDA} [AC4Abu] [Aeea] [Acea] Q R P [NMeArg] [Cha] S H K G [Oic] [Nle] [Deg] [4-Cl-F] {COOH} |
| 412 | {TDA} [AC4Abu] [Aeea] [Aeea] Q R P [NMeArg] [Cha] S H K G [Oic] [Nle] [aMePro] [4-Cl-F] {COOH} |
| 413 | {TDA} [AC4Abu] [Aeea] [Aeea] Q R P [NMeArg] [Cha] S H K G [Oic] [Tle] P [4-Cl-F] {COOH} |
| 414 | {TDA} [AC4Abu] [Aeea] [Aeea] Q R P [NMeArg] [Cha] S H K G [Aib] [Nle] P [4-Cl-F] {COOH} |
| 415 | {TDA} [AC4Abu] [Aeea] [Aeea] Q R P [NMeArg] [Cha] S H K G [Deg] [Nle] P [4-Cl-F] {COOH} |
| 416 | {TDA} [AC4Abu] [Aeea] [Aeea] Q R P [NMeArg] [Cha] S H K G [Pip] [Nle] P [4-Cl-F] {COOH} |
| 417 | {TDA} [AC4Abu] [Aeea] [Aeea] Q R P [NMeArg] [Cha] S H K G [BhPro] [Nle] P [4-Cl-F] {COOH} |
| 418 | {TDA} [AC4Abu] [Aeca] [Acea] Q R P [NMeArg] [Cha] S H K G [aMePro] [Nle] P [4-Cl-F] {COOH} |

TABLE 7-continued

Exemplary Lipid-ApelinPeptide Conjugates

| SEQ ID NO: | SEQUENCE |
|---|---|
| 419 | {TDA} [AC4Abu] [Acea] [Aeea] Q R P [NMeArg] [Cha] S A K G [Oic] [Nle] P [4-Cl-F] {COOH} |
| 420 | {TDA} [AC4Abu] [Aeea] [Acea] [BhAsn] R P [NMeArg] L S H K G P [Nle] P [4-Cl-F] {COOH} |
| 421 | {TDA} [AC4Abu] [Acea] [Aeea] [BhLeu] R P [NMeArg] L S H K G P [Nle] P [4-Cl-F] {COOH} |
| 422 | {TDA} [AC4Abu] [Aeea] [Aeea] Q R P [NMeArg] [BhLeu] S H K G P [Nle] P [4-Cl-F] {COOH} |
| 423 | {TDA} [AC4Abu] [Aeea] [Aeea] Q R P [NMeArg] L S [bAla] K G P [Nle] P [4-Cl-F] {COOH} |
| 424 | {TDA} [AC4Abu] [Aeea] [Aeea] Q R P [NMeArg] L S H [bAla] G P [Nle] P [4-Cl-F] {COOH} |
| 425 | {TDA} [AC4Abu] [Aeea] [Aeea] Q R P [NMeArg] L S H K G P [Nle] [bAla] [4-Cl-F] {COOH} |
| 426 | {TDA} [AC4Abu] [Aeea] [Aeea] Q R P [NMeArg] L S H K G P [Nle] [BhPro] [4-Cl-F] {COOH} |
| 427 | {TDA} [AC4Abu] [Aeea] [Acea] Q R P P L S H K G P [Nle] P [4-Cl-F] {COOH} |
| 428 | {TDA} [AC4Abu] [Aeea] [Aeea] Q R P [Nle] L S H K GP [Nle] P [4-Cl-F] {COOH} |
| 429 | {TDA} [AC4Abu] [Aeea] [Aeea] Q R P [NMeArg] L S H K G P [Nle] [Pip] [4-Cl-F] {COOH} |
| 430 | {TDA} [AC4Abu] [Aeea] [Aeea] Q r P r [Cha] S H K G [Oic] [Nle] P [4-Cl-F] {COOH} |
| 431 | {TDA} [AC4Abu] [Aeea] [Aeea] q [hArg] P r [Cha] S H K G [Oic] [Nle] P [D-Igl] {COOH} |
| 432 | {TDA} [AC4Abu] [Aeea] [Aeea] q [hArg] P r [Cha] S H K G [Oic] [Nle] P [B4ClF] {COOH} |
| 433 | {TDA} [AC4Abu] [Aeea] [Aeea] q [hArg] P r [Tle] S H K G [Oic] [Nle] P [4-Cl-F] {COOH} |
| 434 | {TDA} [AC4Abu] [Aeea] [Aeea] q [hArg] P r [Deg] S H K G [Oic] [Nle] P [4-Cl-F] {COOH} |
| 435 | {TDA} [AC4Abu] [Aeea] [Aeea] Q r P [NMehArg] [Cha] S H K GP [Nle] P [4-Cl-F] {COOH} |
| 436 | {TDA} [AC4Abu] [Aeea] [Aeea] Q R P [NMeArg] [Cha] S Y K G [Oic] [Nle] P [4-Cl-F] {COOH} |
| 437 | {TDA} [AC4Abu] [Aeea] [Aeea] Q R P [NMeArg] [Cha] S V K G [Oic] [Nle] P [4-Cl-F] {COOH} |
| 438 | {TDA} [AC4Abu] [Aeea] [Aeea] Q R P [NMeArg] [Cha] S [Tle] K G [Oic] [Nle] P [4-Cl-F] {COOH} |
| 439 | {TDA} [AC4Abu] [Acea] [Acea] Q R P [NMeArg] [Tle] S H K G [Oic] [Nle] P [4-Cl-F] {COOH} |
| 440 | {TDA} [AC4Abu] [Aeea] [Acea] Q R [Pip] [NMeArg] [Cha] S H K G [Oic] [Nle] P [4-Cl-F] {COOH} |
| 441 | {TDA} [AC4Abu] [Acea] [Aeea] Q R [BhPro] [NMeArg] [Cha] S H K G [Oic] [Nle] P [4-Cl-F] {COOH} |
| 442 | {TDA} [AC4Abu] [Aeea] [Aeea] [Tle] R P [NMeArg] [Cha] S H K G [Oic] [Nle] P [4-Cl-F] {COOH} |
| 443 | {TDA} [AC4Abu] [Aeea] [Aeea] [Deg] R P [NMeArg] [Cha] S H K G [Oic] [Nle] P [4-Cl-F] {COOH} |

TABLE 7-continued

| Exemplary Lipid-ApelinPeptide Conjugates | |
|---|---|
| SEQ ID NO: | SEQUENCE |
| 444 | {TDA} [AC4Abu] [Aeea] [Aeea] Q R P [NMeArg] [Cha] S H[AMe-K] G [Oic] [Nle] P [4-Cl-F] {COOH} |
| 445 | {TDA} [AC4Abu] [Aeea] [Aeea] Q R P [NMeArg] [Cha] S H K G [Oic] [Nle] [Pip] [4-Cl-F] {COOH} |
| 446 | {TDA} [AC4Abu] [Aeea] [Aeea] Q R [NMeArg] [Cha] S H K G [Oic] [Nle] P [4-Cl-F] {COOH} |
| 447 | {TDA} [AC4Abu] [Aeea] [Aeea] Q R [NMeArg] [BLeu] S H K G [Oic] [Nle] P [4-Cl-F] {COOH} |
| 448 | {TDA} [AC4Abu] [Aeea] [Acea] Q R P [NMeArg] L S H H G P [Nle] P [4-Cl-F] {COOH} |
| 449 | {TDA} [AC4Abu] [Aeea] [Aeea] Q R P [NMeArg] L S H [1-Nal] G P [Nle] P [4-Cl-F] {COOH} |
| 450 | {TDA} [AC4Abu] [Aeea] [Aeea] Q R P [NMeArg] L [Pra] H K G P [Nle] P [4-Cl-F] {COOH} |
| 451 | {TDA} [AC4Abu] [Aeea] [Aeea] q [hArg] P r [Cha] S [Deg] K G [Oic] [Nle] P [4-Cl-F] {COOH} |
| 452 | {TDA} [AC4Abu] [Aeea] [Aeea] q [hArg] P r [Cha] S[Tle] K G [Oic] [Nle] P [4-Cl-F] {COOH} |
| 453 | {TDA} [AC4Abu] [Aeea] [Aeea] q [hArg] P r [Cha] S H K G [Oic] [Nle] [D-4IF] {COOH} |
| 454 | {TDA} [AC4Abu] [Aeea] [Aeea] q [hArg] [Aib] r [Cha] S H K G [Oic] [Nle] P [4-Cl-F] {COOH} |
| 455 | {TDA} [AC4Abu] [Aeea] [Aeea] q [hArg] [Deg] r [Cha] S H K G [Oic] [Nle] P [4-Cl-F] {COOH} |
| 456 | {TDA} [AC4Abu] [Aeea] [Aeea] Q r P [NMehArg] [aMeLeu] S H K G P [Nle] P [4-Cl-F] {COOH} |
| 457 | {TDA} [AC4Abu] [Aeea] [Aeea] Q R P [NMeArg] [aMeLeu] S H K G P [Nle] P [4-Cl-F] {COOH} |
| 458 | {TDA} [AC4Abu] [Aeea] [Aeea] Q R P [NMeArg] [BLeu] S H K G P [Nle] P [4-Cl-F] {COOH} |
| 459 | {TDA} [AC4Abu] [Aeea] [Acea] Q R P [NMeArg] [NMeLeu] S H K G P [Nle] P [4-Cl-F] {COOH} |
| 460 | {TDA} [AC4Abu] [Aeea] [Aeea] Q [hArg] P [NMeArg] [aMeLeu] S H K G P [Nle] P [4-Cl-F] {COOH} |
| 461 | {AdpA} [AC4Abu] [Aeea] [Aeea] Q R P [NMeArg] L S H K GP [Nle] P [4-Cl-F] {COOH} |
| 462 | {TDA} [AC4Abu] [AC4Abu] [Aeea] Q R P [NMeArg] L S H K GP [Nle] P [4-Cl-F] {COOH} |
| 463 | {TDA} [AC4Abu] [Aeea] [Aeea] [BhGIn] R P [NMeArg] L S H K GP [Nle] P [4-Cl-F] {COOH} |
| 464 | {TDA} [AC4Abu] [Acea] [Aeea] Q R P [NMeArg] L [bAla] H K G P [Nle] P 4-Cl-F] {COOH} |
| 465 | {TDA} [AC4Abu] [Aeea] [Aeea] Q R P Q L S H K G P [Nle] P [4-Cl-F] {COOH} |
| 466 | {TDA} [AC4Abu] [Aeea] [Aeea] Q R P [NMeArg] L S H [Nle] GP [Nle] P [4-Cl-F] {COOH} |
| 467 | {TDA} [AC4Abu] [Acea] [Aeea] Q R P [NMeArg] L [NhSerG] H K G P [Nle] P [4-Cl-F] {COOH} |
| 468 | {TDA} [AC4Abu] [Aeea] [Aeea] Q R P [NMeArg] L [aMeS] H K G P [Nle] P [4-Cl-F] {COOH} |

TABLE 7-continued

Exemplary Lipid-ApelinPeptide Conjugates

| SEQ ID NO: | SEQUENCE |
|---|---|
| 469 | {TDA} [AC4Abu] [Aeea] [Aeea] Q R P [NMeArg] L S [rHis] K G P [Nle] P 4-Cl-F] {COOH} |
| 470 | {TDA} [AC4Abu] [Aeea] [Aeea] Q R P [NMeArg] L S H K GP [Nle] P [2Nal] {COOH} |
| 471 | {TDA} [AC4Abu] [Aeea] [Aeea] Q R P [NMehArg] L S H K G P [Nle] P [2Nal] {COOH} |
| 472 | {TDA} [AC4Abu] [Aeea] [Aceea] Q R P [NMeArg] [aMeLeu] S H K G P [Nle] P [2Nal] {COOH} |
| 473 | {TDA} [AC4Abu] [Aeea] [Aeea] Q [hArg] P [NMeArg] [aMeLeu] S H K G P [Nle] P [2Nal] {COOH} |
| 474 | {Sebacicacid} [AC4Abu] [Aeea] [Aeea] [hArg] Q [hArg] P [NMeArg] [Cha] S H K G [Oic] [Nle]P [4-Cl-F] {COOH} |
| 475 | {TDA} [AC4Abu] [Aeea] [Aeea] Q E P [NMeArg] L S H K G P [Nle] P [4-Cl-F] {COOH} |
| 476 | {TDA} [AC4Abu] [Aeea] [Aeea] Q R E [NMeArg] L S H K G P [Nle] P [4-Cl-F] {COOH} |
| 477 | {TDA} [AC4Abu] [Aeea] [Aeea] Q R P E L S H K G P [Nle] P [4-Cl-F] {COOH} |
| 478 | {TDA} [AC4Abu] [Aeea] [Aeea] q[hArg] P [NMeArg] [Cha] S H K G [Oic] [Nle] P [4-Cl-F] {COOH} |
| 479 | {TDA} [AC4Abu] [Acea] [Aeea] r Q [hArg] P [NMeArg] [Cha] S H K G [Oic] [Nle]P [4-Cl-F] {COOH} |
| 480 | {TDA} [AC4Abu] [Aeea] [Aeea] r Q [hArg] P [hArg] [Cha] S H K G [Oic] [Nle] P [4-Cl-F] {COOH} |
| 481 | {TDA} [AC4Abu] [Aeea] [Aeea] r q [hArg] P [hArg] [Cha] S H K G [Oic] [Nle] P [4-Cl-F] {COOH} |
| 482 | {TDA} [AC4Abu] [Aeea] [Aeea] Q R [aMePro] [hArg] [aMeLeu] S H K G P [Nle] P [4-Cl-F] {COOH} |
| 483 | {TDA} [AC4Abu] [Aeea] [Aeea] Q [hArg]P [NMehArg] L S H K G P [Nle] P [4-Cl-F] {COOH} |
| 484 | {TDA} [AC4Abu] [Aeea] [Aeea] Q [NMehArg] P [NMeArg] [aMeLeu] S H K GP [Nle]P [4-Cl-F] {COOH} |
| 485 | {TDA} [AC4Abu] [Aeea] [Aeea] Q r P [hArg] [aMeLeu] S H K G P [Nle]P [4-Cl-F] {COOH} |
| 486 | {TDA} [AC4Abu] [Acea] [Acea] q [hArg] [Oic] r [Cha] S H K G [Oic] [Nle] P [4-Cl-F] {COOH} |
| 487 | {TDA} [AC4Abu] [Aeea] [Acea] Q R P [NMeArg] [Cha] S H K G [Oic] [Nle] [BhPro] [4-Cl-F] {COOH} |
| 488 | {TDA} [AC4Abu] [Aeea] [Aeea] q[hArg]P [hArg] [Cha] S H K G [Oic] [Nle] P [4-Cl-F] {COOH} |
| 489 | {TDA} [AC4Abu] [Aeea] [Aeea] Q [hArg]P [hArg] [Cha] S H K G [Oic] [Nle] P [4-Cl-F] {COOH} |
| 490 | {TDA} [AC4Abu] [Aeea] [Aeea] [hArg] Q [hArg]P [hArg] [Cha] S H K G [Oic] [Nle]P [4-Cl-F] {COOH} |
| 491 | {Butanoyl} [AC4Abu] [Acea] [Aeea] Q R P [NMeArg] L S H K GP [Nle]P [4-Cl-F] {COOH} |
| 492 | {hexanoyl} [AC4Abu] [Acea] [Aeea] Q R P [NMeArg] L S H K GP [Nle]P [4-Cl-F] {COOH} |
| 493 | {Oc} [AC4Abu] [Acea] [Aeea] Q R P [NMeArg] L S H K GP [Nle]P [4-Cl-F] {COOH} |

TABLE 7-continued

Exemplary Lipid-ApelinPeptide Conjugates

| SEQ ID NO: | SEQUENCE |
|---|---|
| 494 | {Decanoyl} [AC4Abu] [Aeea] [Aeea] Q R P [NMeArg] L S H K GP [Nle]P [4-Cl-F] {COOH} |
| 495 | {PDA} [AC4Abu] [Aeea] [Aeea] Q R P [NMeArg] L S H K GP [Nle]P [4-Cl-F] {COOH} |
| 496 | {HDA} [AC4Abu] [Aeea] [Aeea] Q R P [NMeArg] L S H K GP [Nle]P [4-Cl-F] {COOH} |
| 497 | {Succinicacid} [AC4Abu] [Aeea] [Aeea] Q R P [NMeArg] L S H K GP [Nle] P [4-Cl-F] {COOH} |
| 498 | {TDA} [AC4Abu] [Aeea] [Aeea] q R P [NMeArg] [Cha] S H K G [aMePro] [Nle] [Aib] [4-Cl-F] {COOH} |
| 499 | {TDA} [AC4Abu] [Aeea] [Aeea] q R P [NMeArg] [Cha] S H K G [Pip] [Nle] [Aib] [4-Cl-F] {COOH} |
| 500 | {TDA} [AC4Abu] [Aeea] [Aeea] q R P [NMeArg] [Cha] [BhSer] H K G [Oic] [Nle] [Aib] [4-Cl-F] {COOH} |
| 501 | {TDA} [AC4Abu] [Acea] [Aeea] q R[aMePro] [hArg] [BLeu] S H K G [Pip] [Nle] [4-Cl-F] {COOH} |
| 502 | {TDA} [AC4Abu] [Aeea] [Aeea] q R[aMePro] [hArg] [BLeu] S H K G [Oic] [Nle] [aMePro] [4-Cl-F] {COOH} |
| 503 | {TDA} [AC4Abu] [Aeea] [Acea] q R[aMePro] [hArg] [BLeu] S H K G [Pip] [Nle] [aMePro] [4-Cl-F] {COOH} |
| 504 | {TDA} [AC4Abu] [Acea] [Aeea] q R[aMePro] [hArg] [BLeu] S H K G [aMePro] [Nle] [aMePro] [4-Cl-F] {COOH} |
| 505 | {TDA} [AC4Abu] [Aeea] [Aeea] q R[aMePro] [hArg] [BLeu] S H K G [Oic] [Nle] [Aib] [4-Cl-F] {COOH} |
| 506 | {hexanoyl} [AC4Abu] [Aeea] [Aeea] [Acea] [hArg] Q [hArg]P [NMeArg] [Cha] S H K G [Oic] [Nle]P [4-Cl-F] {COOH} |
| 507 | {TDA} [Aeea] [Aeea] Q R P [NMeArg] L S H K GP [Nle]P [4-Cl-F] {COOH} |
| 508 | {Subericacid} [AC4Abu] [Aeea] [Acea] Q R P [NMeArg] L S H K GP [Nle] P [4-Cl-F] {COOH} |
| 509 | {Sebacicacid} [AC4Abu] [Aeea] [Aeea] Q R P [NMeArg] L S H K GP [Nle] P [4-Cl-F] {COOH} |
| 510 | {DDDA} [AC4Abu] [Acea] [Acea] Q R P [NMeArg] L S H K GP [Nle] P [4-Cl-F] {COOH} |
| 511 | {TetDDA} [AC4Abu] [Aeea] [Aeea] Q R P [NMeArg] L S H K GP [Nle] P [4-Cl-F] {COOH} |
| 512 | {HexDDA} [AC4Abu] [Aeea] [Aeea] Q R P [NMeArg] L S H K GP [Nle] P [4-Cl-F] {COOH} |
| 513 | {ODDA} [AC4Abu] [Aeea] [Aeea] Q R P [NMeArg] L S H K GP [Nle] P [4-Cl-F] {COOH} |
| 514 | {hexanoyl} [AC4Abu] [Aeea] [Aeea] Q r P [hArg] [aMeLeu] S H K G P [Nle]P [4-Cl-F] {COOH} |
| 515 | {AdpA} [AC4Abu] [Aeea] [Acea] Q r P [hArg] [aMeLeu] S H K GP [Nle] P [4-Cl-F] {COOH} |
| 516 | {TDA} [AC4Abu] [Aeea] [Aeea] q R [BhPro] [NMeArg] [Cha] S H K G [Oic] [Nle] [Aib] [4-Cl-F] {COOH} |
| 517 | {TDA} [AC4Abu] [Aeea] [Aeea] q R [Pip] [NMeArg] [Cha] S H K G [Oic] [Nle] [Aib] [4-Cl-F] {COOH} |
| 518 | {TDA} [AC4Abu] [Aeea] [Acea] q R P [NMeArg] [aMeLeu] [BhSer] H K G [Oic] [Nle] [aMePro] [4-Cl-F] {COOH} |

TABLE 7-continued

| Exemplary Lipid-ApelinPeptide Conjugates | |
|---|---|
| SEQ ID NO: | SEQUENCE |
| 519 | {TDA} [AC4Abu] [Aeea] [Aeea] q R [aMePro] [hArg] [BLeu] S H K G [Oic] [Nle] [4-Cl-F] {COOH} |
| 520 | {TDA} [AC4Abu] [Aeea] [Aeea] Q P [NMeArg] [Cha] S H K G [Oic] [Nle] [Aib] [4-Cl-F] {COOH} |
| 521 | {TDA} [AC4Abu] [Aeea] [Aeea] q R [Pip] [hArg] [BLeu] S H K G [Oic] [Nle] [Aib] [4-Cl-F] {COOH} |
| 522 | {TDA} [AC4Abu] [Aeea] [Aeca] q R [BhPro] [hArg] [BLeu] S H K G [Oic] [Nle] [Aib] [4-Cl-F] {COOH} |
| 523 | {TDA} [AC4Abu] [Aeea] [Acea] q R [aMePro] [Nle] [BLeu] S H K G [Oic] [Nle] [aMePro] [4-Cl-F] {COOH} |
| 524 | {TDA} [AC4Abu] [Aeea] [Acea] q E P [NMeArg] [Cha] S H K G [Oic] [Nle] [Aib] [4-Cl-F] {COOH} |
| 525 | {TDA} [AC4Abu] [Aeea] [Aeea] q e P [NMeArg] [Cha] S H K G [Oic] [Nle] [Aib] [4-Cl-F] {COOH} |
| 526 | {TDA} [AC4Abu] [Aeea] [Acea] q R P E [Cha] S H K G [Oic] [Nle] [Aib] [4-Cl-F] {COOH} |
| 527 | {TDA} [AC4Abu] [Acea] [Acea] q R Pe[Cha] S H K G [Oic] [Nle] [Aib] [4-Cl-F] {COOH} |
| 528 | {TDA} [AC4Abu] [Aeea] [Acea] q R P [Nle] [Cha] S H K G [Oic] [Nle] [Aib] [4-Cl-F] {COOH} |
| 529 | {TDA} [AC4Abu] [Aeea] [Acca] q R P [Nle] [Cha] S A K G [Oic] [Nle] [Aib] [4-Cl-F] {COOH} |
| 530 | {TDA} [AC4Abu] [Aeea] [Aeea] q R P [NMeArg] [Cha] S A K G [Oic] [Nle] [Aib] [4-Cl-F] {COOH} |
| 531 | {TDA} [AC4Abu] [Aeea] [Aeea] q R P [NMeArg] [Cha] S Y K G [Oic] [Nle] [ Aib] [4-Cl-F] {COOH} |
| 532 | {TDA} [AC4Abu] q R P [NMeArg] [Cha] S H K G [Oic] [Nle] [Aib] [4-Cl-F] {COOH} |
| 533 | {TDA} [AC4Abu] [AC4Abu] q R P [NMeArg] [Cha] S H K G [Oic] [Nle] [Aib] [4-Cl-F] {COOH} |
| 534 | {TDA} [AC4Abu] [AC4Abu] [Aeea] [Aeea] q R P [NMeArg] [Cha] S H K G [Oic] [Nle] [Aib] [4-Cl-F] {COOH} |
| 535 | {TDA} [AC4Abu] [AC4Abu] [Aeea] q R P [NMeArg] [Cha] S H K G [Oic] [Nle] [Aib] [4-Cl-F] {COOH} |
| 536 | {TDA} [AC4Abu] [Aeea] [AC4Abu] q R P [NMeArg] [Cha] S H K G [Oic] [Nle] [ Aib] [4-Cl-F] {COOH} |
| 537 | {TDA}E[Aeea] [Aeea] q R P [NMeArg] [Cha] S H K G [Oic] [Nle] [Aib] [4-Cl-F] {COOH} |
| 538 | {TDA}d[Aeea] [Aeea] q R P [NMeArg] [Cha] S H K G [Oic] [Nle] [Aib] [4-Cl-F] {COOH} |
| 539 | {TDA} [AC4Abu] [NPeg11] q R P [NMeArg] [Cha] S H K G [Oic] [Nle] [Aib] [4-Cl-F] {COOH} |
| 540 | {TDA} [AC4Abu] [Aeea] [Aeea] q R P [NMeArg] [Cha] S H K G [Oic] [Nle] [Aib] [4-Cl-F] {COOH} |
| 541 | {TDA} [AC4Abu] [Acea] [Aeea] q R P [NMeArg] [Cha] S H K G [Oic] [Nle] [aMePro] [4-Cl-F] {COOH} |
| 542 | {TDA} [AC4Abu] [Aeea] [Acea] q R P [NMeArg] [Cha] S H K G [Oic] [Nle] [BhPro] [4-Cl-F] {COOH} |
| 543 | {TDA} [AC4Abu] [Aeea] [Aeea] q R P [NMeArg] [Cha] S H K [Tle] [Oic] [Nle] [Aib] [4-Cl-F] {COOH} |

TABLE 7-continued

Exemplary Lipid-ApelinPeptide Conjugates

| SEQ ID NO: | SEQUENCE |
|---|---|
| 544 | {TDA} [AC4Abu] [Aeea] [Aeea] q R P [NMeArg] [Cha] S H K G [Pip] [Nle] [BhPro] [4-Cl-F] {COOH} |
| 545 | {TDA} [AC4Abu] [Acea] [Acea] q R P [NMeArg] [Cha] S H K G [aMePro] [Nle] [BhPro] [4-Cl-F] {COOH} |
| 546 | {TDA}D[Aeea] [Acea] q R P [NMeArg] [Cha] S H K G [Oic] [Nle] [Aib] [4-Cl-F] {COOH} |
| 547 | {TDA} e [Aeea] [Aeea] q R P [NMeArg] [Cha] S H K G [Oic] [Nle] [Aib] [4-Cl-F] {COOH} |
| 548 | {H2} H A E G T F T S D V S S Y L E G Q A A K (AC4Abu-Palm) E F I A W L VRGRG{COOH} |
| 549 | {TDA} [AC4Abu] [Aeea] [Aeea] q R P [NMeArg] [Cha] S H K G [Oic] [Nle] [Deg] [4-Cl-F] {COOH} |
| 550 | {TDA} [AC4Abu] [Aeea] [Aeea] Q [BhPro] [NMeArg] [Cha] S H K G [Oic] [Nle] [Aib] [4-Cl-F] {COOH} |
| 551 | {TDA} [AC4Abu] [Aeea] [Aeea] q R P [NMeArg] [Cha] S H K G [aMePro] [Nle] [4-Cl-F] {COOH} |
| 552 | {TDA} [AC4Abu] [Aeea] [Aeca] [BLeu] R[aMePro] [hArg] [aMeLeu] S H K G [Oic] [Nle] [aMePro] [4-Cl-F] {COOH} |
| 553 | {TDA} [AC4Abu] [Aeea] [Aeea] q R[BhPro] [NMeArg] [aMeLeu] S H K G [Oic] [Nle] [aMePro] [4-Cl-F] {COOH} |
| 554 | {TDA} [AC4Abu] [Aeea] [Aeea] q R P [NMeArg] [aMeLeu] S H K G [Oic] [Nle] [BhPro] [4-Cl-F] {COOH} |
| 555 | {TDA} [AC4Abu] [Aeea] [Aeea] q R P [NMeArg] [aMeLeu] S H K G [Pip] [Nle] [aMePro] [4-Cl-F] {COOH} |
| 556 | {TDA} [AC4Abu] [Aeea] [Aeea] q R[aMePro] [hArg] [BLeu] S H K G [Oic] [Nle] [BhPro] [4-Cl-F] {COOH} |
| 557 | {TDA} [AC4Abu] [Aeea] [Aeea] [Tle] [hArg]Pr[Cha] S H K G [Oic] [Nle] P [4-Cl-F] {COOH} |
| 558 | {TDA} [AC4Abu] [Aeea] [Aeea] [Deg] [hArg]Pr[Cha] S H K G [Oic] Nle] P [4-Cl-F] {COOH} |
| 559 | {hexanoyl} [AC4Abu] [Aeea] [Aeea] Q R P [hArg] [aMeLeu] S H K G P [Nle] P [4-Cl-F] {COOH} |
| 560 | {hexanoyl} [AC4Abu] [Aeea] [Aeea] Q R [aMePro] [hArg] [aMeLeu] S H K G P [Nle] P [4-Cl-F] {COOH} |
| 561 | {hexanoyl} [AC4Abu] [Aeea] [Aeea] Q [NMehArg]P [NMeArg] [aMeLeu] S H K G P [Nle] P [4-Cl-F] {COOH} |
| 562 | {hexanoyl} [AC4Abu] [Aeea] [Aeea] Q R P [NMeArg] [Cha] S H K G [Oic] [Nle] [Aib] [4-Cl-F] {COOH} |
| 563 | {hexanoyl} [AC4Abu] [Acea] [Aeea] [hArg] r Q [hArg]Pr[NMeLeu] S H K G [Pip] [pI-Phe]P [D-Bip] {COOH} |
| 564 | {TDA} [AC4Abu] [Aeea] [Aeea] RQ [Nle]P [hArg] [Cha] SA K G [Pip] [Nle] P [4-Cl-F] {COOH} |
| 565 | {TDA} [AC4Abu] [Aeea] [Aeea] r Q R P [hArg] [NMeLeu] S H K G [Pip] [p]-Phe] P [D-Bip] {COOH} |
| 566 | {hexanoyl} [Ahx] [AC4Abu] [Aeea] [Aeea] [hArg] r Q [hArg]Pr[NMeLeu] S H KG [Oic] [pI-Phe] P [D-Bip] {COOH} |
| 567 | {Palm} [AC4Abu] [Aeea] [Aeea] q R P [NMeArg] [Cha] S H K G [Oic] [Nle] P [D-BhPhe] {COOH} |
| 568 | {Palm} [AC4Abu] [Aeea] [Aeea] q R P [NMeArg] [Cha] S H K G [Pip] [Nle] P [D-BhPhe] {COOH} |

TABLE 7-continued

Exemplary Lipid-ApelinPeptide Conjugates

| SEQ ID NO: | SEQUENCE |
|---|---|
| 569 | {Palm} [AC4Abu] [Aeea] [Aeea] q R P [NMeArg] [Cha] S H K G [Oic] [Nle] [Aib] [D-BhPhe] {COOH} |
| 570 | {Palm} [AC4Abu] [Aeea] [Aeea] q R P [NMeArg] [Cha] S H K G [Oic] [Nle] [aMePro] [D-BhPhe] {COOH} |
| 571 | {Palm} [AC4Abu] [Aeea] [Aeea] q R P [NMeArg] [Cha] S H K G [Oic] [Nle] [BhPro] [D-BhPhe] {COOH} |
| 572 | {Palm} [AC4Abu] [Aeea] [Acea] q R P [NMeArg] [Cha] S H K G [Oic] [Nle] [bAla] [D-BhPhe] {COOH} |
| 573 | {Palm} [AC4Abu] [Aeea] [Aeea] q R P [NMeArg] [Cha] S H K G [Oic] [Nle] [D-BhPhe] {COOH} |
| 574 | {Palm} [AC4Abu] [Acea] [Acea] q R P [NMeArg] [Cha] S H K G [Pip] [Nle] [D-BhPhe] {COOH} |
| 575 | {Palm} [AC4Abu] [Aeea] [Aeea] q R P [NMeArg] [Cha] S H K G [Oic] [Nle] P [BhPhe] {COOH} |
| 576 | {HDA} [AC4Abu] [Aeea] [Acea] q R P [NMeArg] [Cha] S H K G [Oic] [Nle] P [D-4ClF] {COOH} |
| 577 | {Palm} [AC4Abu] [Acea] [Acea] q R P [NMeArg] [Cha] S H K G [Oic] [Nle] [Aib] [BhPhe] {COOH} |
| 578 | {Palm} [AC4Abu] [Aeca] [Aeea] q R P [NMeArg] [Cha] S H K G [Oic] [Nle] [BhPhe] {COOH} |
| 579 | {Palm} [AC4Abu] [Acea] [Aeea] q R P [NMeArg] [Cha] S H K G [Pip] [Nle] [BhPhe] {COOH} |
| 580 | {Palm} [AC4Abu] [Aeea] [Aeea] q R P [NMeArg] [Cha] S H K G [Oic] [Aib] [4-Cl-F] {COOH} |
| 581 | {Palm} [AC4Abu] [Aeea] [Acea] q R P [NMeArg] [Cha] S H K G [Pip] [Aib][4-Cl-F] {COOH} |
| 582 | {Palm} [AC4Abu] [Aeea] [Aeea] q R P [NMeArg] [Cha] S H K G [Nip] [Nle] [Aib] [4-Cl-F] {COOH} |
| 583 | {Palm} [AC4Abu] [Acea] [Aeea] q R P [NMeArg] [Cha] S H K G [Inp] [Nle] [Aib] [4-Cl-F] {COOH} |
| 584 | {Palm} [AC4Abu] [Aeea] [Acea] q R P [NMeArg] [Cha] S H K G [Oic] [Nle] [1-Ach] [4-Cl-F] {COOH} |
| 585 | {Palm} [AC4Abu] [Aeea] [Acea] q R P [NMeArg] [Cha] S H K G [Oic] [Nle] [Acp] [4-Cl-F] {COOH} |
| 586 | {Palm} [AC4Abu] [Aeea] [Acea] q R P [NMeArg] [Cha] S H K G [Oic] [Nle] [Nip] [4-Cl-F] {COOH} |
| 587 | {Palm} [AC4Abu] [Aeea] [Aeea] q R P [NMeArg] [Cha] S H K G [Oic] [Nle] [Inp] [4-Cl-F] {COOH} |
| 588 | {Palm} [AC4Abu] [Aeea] [Aeea] q R P [NMeArg] [Cha] S H K G [Pip] [Nle] [Nip] [4-Cl-F] {COOH} |
| 589 | {Palm} [AC4Abu] [Aeea] [Aeea] Q R P [NMeArg] [Cha] S H K G [Pip] [Nle] [Inp] [4-Cl-F] {COOH} |
| 590 | {Palm} [AC4Abu] [Acea] [Acea] q R P [NMeArg] [Cha] S H K G [Pip] [Nle] P [Aic] {COOH} |
| 591 | {Dodecanoyl-NH} [AC4Abu] [Aeea] [Aeea] Q R P [NMeArg] L S H K GP [Nle] P [4-Cl-F] {COOH} |
| 592 | {Myristyl-NH} [AC4Abu] [Aeea] [Aeea] Q R P [NMeArg] L S H K GP [Nle] P [4-Cl-F] {COOH} |
| 593 | {Palm} [AC4Abu] [Aeea] [Aeea] Q R P [NMeArg] L S H K GP [Nle]P [4-Cl-F] {COOH} |

TABLE 7-continued

Exemplary Lipid-ApelinPeptide Conjugates

| SEQ ID NO: | SEQUENCE |
|---|---|
| 594 | {St} [AC4Abu] [Aeea] [Aeea] Q R P [NMeArg] L S H K GP [Nle] P [4-Cl-F] {COOH} |
| 595 | {TDA} [AC4Abu] [Aeea] [Aeea] q [hArg] P r [Cha] S H K G [Oic] [Nle] [Aic] {COOH} |
| 596 | {TDA} [AC4Abu] [Aeea] [Aeea] q [hArg] P r [Cha] S H K G [Oic] [Nle] [Oic] {COOH} |
| 597 | {Palm} [AC4Abu] [Aeea] [Acea] q R P [NMeArg] [Cha] S H K G [Pip] [Nle] [Aic] {COOH} |
| 598 | {Palm} [AC4Abu] [Acea] [Acea] q R P [NMeArg] [Cha] S H K G [Pip] [Nle] P [Tic] {COOH} |
| 599 | {Palm} [AC4Abu] [Aeea] [Aeea] q R P [NMeArg] [Cha] S H K G [Pip] [Nle] P [D-Tic] {COOH} |
| 600 | {Palm} [AC4Abu] [Acea] [Aeea] q R P [NMeArg] [Cha] S H K G [Oic] [Nle] [BhPro] [D-4ClF] {COOH} |
| 601 | {Palm} [AC4Abu] [Aeea] [Aeea] q R P [NMeArg] [Cha] S H K G [Oic] [Nle] [Pip] [D-4ClF] {COOH} |
| 602 | {Palm} [AC4Abu] [Aeea] [Aeea] q R P [NMeArg] [Cha] S H K G [Oic] [Nle] [Nip] [D-4ClF] {COOH} |
| 603 | {Palm} [AC4Abu] [Aeea] [Aeea] q R P [NMeArg] [Cha] S H K G [Oic] [Nle] [Inp] [D-4ClF] {COOH} |
| 604 | {Palm} [AC4Abu] [Aeea] [Aeea] q R P [NMeArg] [Cha] S H K G [Oic] [Nle] [Aib] [D-4ClF] {COOH} |
| 605 | {TDA} [AC4Abu] [Aeea] [Aeea] Q R P [NMeArg] [aMeLeu] S H K G [Pip] [Nle] [aMePro] [4-Cl-F] {COOH} |
| 606 | (Palm} [AC4Abu] [Aeea] [Aeea] q R P [NMeArg] [Cha] S H K G [Oic] [Nle] P [AMEF] {COOH} |
| 607 | {Palm} [AC4Abu] [Acea] [Aeea] q R P [NMeArg] [Cha] S H K G [Oic] [Nle] P [D-AMF] {COOH} |
| 608 | {Palm} [AC4Abu] [Aeea] [Aeea] q R P [NMeArg] [Cha] S H K G [Oic] [Nle] [Aib] [AMEF] {COOH} |
| 609 | {Palm} [AC4Abu] [Aeea] [Aeea] q R P [NMeArg] [Cha] S H K G [Oic] [Nle] [Pip] [AMEF] {COOH} |
| 610 | {Palm} [AC4Abu] [Aeea] [Aeea] q R P [NMeArg] [Cha] S H K G [Oic] [Nle] [aMePro] [AMEF] {COOH} |
| 611 | {Palm} [AC4Abu] [Aeea] [Acea] q R P [NMeArg] [Cha] S H K G [Oic] [Nle] [BhPro] [AMEF] {COOH} |
| 612 | {Palm} [AC4Abu] [Aeea] [Aeea] q R P [NMeArg] [Cha] S H K G [Oic] [Nle] [BhPro] [D-AMF] {COOH} |
| 613 | {Palm} [AC4Abu] [Aeea] [Aeea] q R P [NMeArg] [Cha] S H K G [BhPro] [Nle] [4-Cl-F] {COOH} |
| 614 | {Palm} [AC4Abu] [Aeca] [Aeea] q[hArg]Pr[Cha] S H K G [Oic] [Nle]P [D-BhPhe] {COOH} |
| 615 | {Palm} [AC4Abu] [Aeea] [Aeea] q R P [NMeArg] [Cha] [BLeu] H K G [Oic] [Nle] [BhPro] [D-BhPhe] {COOH} |
| 616 | {Palm} [AC4Abu] [Aeea] [Aeea] q R P [NMeArg] [Cha] S [Dap] K G [Oic] [Nle] [BhPro] [D-BhPhe] {COOH} |
| 617 | {Palm} [AC4Abu] [Aeea] [Aeea] q R P [NMeArg] [Cha] Sh K G [Oic] [Nle] [BhPro] [D-BhPhe] {COOH} |
| 618 | {Palm} [AC4Abu] [Aeea] [Aeea] q R P [NMeArg] [Cha] S H O G [Oic] [Nle] [BhPro] [D-BhPhe] {COOH} |

TABLE 7-continued

| Exemplary Lipid-ApelinPeptide Conjugates | |
|---|---|
| SEQ ID NO: | SEQUENCE |
| 619 | {Palm} [AC4Abu] [Aeea] [Aeea] q R P [NMeArg] [Cha] S H [aMeOrn] G [Oic] [Nle] [BhPro] [D-BhPhe] {COOH} |
| 620 | {Palm} [AC4Abu] [Aeea] [Acea] q R P [NMeArg] [Cha] S H [3Pal] G [Oic] [Nle] [BhPro] [D-BhPhe] {COOH} |
| 621 | {Palm} [AC4Abu] [Acea] [Aeea] q R P [NMeArg] [Cha] S H [4-Cl-F] G [Oic] [Nle] [BhPro] [D-BhPhe] {COOH} |
| 622 | {Palm} [AC4Abu] [Aeea] [Aeea] q R P [NMeArg] [Cha] S H [4-F-F] G [Oic] [Nle] [BhPro] [D-BhPhe] {COOH} |
| 623 | {Palm} [AC4Abu] [Aeea] [Aeea] q R P [NMeArg] [Cha] S H [Dab] G [Oic] [Nle] [BhPro] [D-BhPhe] {COOH} |
| 624 | {Palm} [AC4Abu] [Aeea] [Aeea] q R P [NMeArg] [Cha] S H [Dap] G [Oic] [Nle] [BhPro] [D-BhPhe] {COOH} |
| 625 | {Palm} [AC4Abu] [Aeea] [Aeea] q R P [NMeArg] [Cha] S H [Igl] G [Oic] [Nle] [BhPro] [D-BhPhe] {COOH} |
| 626 | {Palm} [AC4Abu] [Aeea] [Aeea] q R P [NMeArg] [Cha] S H K [Sar] [Oic] [Nle] [BhPro] [D-BhPhe] {COOH} |
| 627 | {Palm} [AC4Abu] [Aeea] [Aeea] q R P [NMeArg] [aMeLeu] [aMeS] H K G [Oic] [Nle] [BhPro] [4-Cl-F] {COOH} |
| 628 | {Palm} [AC4Abu] [Aeea] [Aeea] q R P [NMeArg] [aMeLeu] [BLeu] H K G [Oic] [Nle] [BhPro] [4-Cl-F] {COOH} |
| 629 | {Palm} [AC4Abu] [Aeea] [Acea] q R P [NMeArg] [aMeLeu] S [Bip] K G [Oic] [Nle] [BhPro] [4-Cl-F] {COOH} |
| 630 | {Palm} [AC4Abu] [Aeea] [Aeea] q R P [NMeArg] [aMeLeu] S [Dap] K G [Oic] [Nle] [BhPro] [4-Cl-F] {COOH} |
| 631 | {Palm} [AC4Abu] [Acea] [Aeea] q R P [NMeArg] [aMeLeu] S h K G [Oic] [Nle] [BhPro] [4-Cl-F] {COOH} |
| 632 | {Palm} [AC4Abu] [Acea] [Acea] q R P [NMeArg] [aMeLeu] S H [NPipG] G [Oic] [Nle] [BhPro] [4-Cl-F] {COOH} |
| 633 | {Palm} [AC4Abu] [Aeea] [Aeea] q R P [NMeArg] [Cha] S H [NPipG] G [Oic] [Nle] [BhPro] [D-BhPhe] {COOH} |
| 634 | {Palm} [AC4Abu] [Aeea] [Aeea] q R P [NMeArg] [aMeLeu] S H O G [Oic] [Nle] [BhPro] [4-Cl-F] {COOH} |
| 635 | {Palm} [AC4Abu] [Aeea] [Aeea] q R P [NMeArg] [aMeLeu] S H [aMeOrn] G [Oic] [Nle] [BhPro] [4-Cl-F] {COOH} |
| 636 | {Palm} [AC4Abu] [Aeea] [Aeea] q R P [NMeArg] [aMeLeu] S H [3Pal] G [Oic] [Nle] [BhPro] [4-Cl-F] {COOH} |
| 637 | {Palm} [AC4Abu] [Aeea] [Aeea] q R P [NMeArg] [aMeLeu] S H [4-F-F] G [Oic] [Nle] [BhPro] [4-Cl-F] {COOH} |
| 638 | {Palm} [AC4Abu] [Aeea] [Aeea] q R P [NMeArg] [aMeLeu] S H [Dab] G [Oic] [Nle] [BhPro] [4-Cl-F] {COOH} |
| 639 | (Palm} [AC4Abu] [Aeea] [Aeea] q R P [NMeArg] [aMeLeu] S H [Dap] G [Oic] [Nle] [BhPro] [4-Cl-F] {COOH} |
| 640 | {Palm} [AC4Abu] [Aeea] [Aeea] q R P [NMeArg] [aMeLeu] S H [Igl] G [Oic] [Nle] [BhPro] [4-Cl-F] {COOH} |
| 641 | (Palm} [AC4Abu] [Aeea] [Aeea] q R P [NMeArg] [aMeLeu] S H K[Sar] [Oic] [Nle] [BhPro] [4-Cl-F] {COOH} |
| 642 | {Palm} [AC4Abu] [Aeea] [Aeea] q R P [NMeArg] [Cha] [aMeS] H K G [Oic] [Nle] [BhPro] [D-BhPhe] {COOH} |
| 643 | {Palm} [AC4Abu] [Aeea] [Aeea] q R P [NMeArg] [Cha] [NPrG] H K G [Pip] [Nle] [Aib] [4-Cl-F] {COOH} |

TABLE 7-continued

Exemplary Lipid-ApelinPeptide Conjugates

| SEQ ID NO: | SEQUENCE |
|---|---|
| 644 | {Palm} [AC4Abu] [Aeea] [Aeea] q R P [NMeArg] [Cha] S[NPrG] K G [Pip] [Nle] [Aib] [4-Cl-F] {COOH} |
| 645 | {Palm} [AC4Abu] [Aeea] [Aeea] q R P [NPipG] [Cha] S H K G [Pip] [Nle] [Aib] [4-Cl-F] {COOH} |
| 646 | (Palm} [AC4Abu] [Aeea] [Aeea] q[NPipG] P [NMeArg] [Cha] S H K G [Pip] [Nle] [Aib] [4-Cl-F] {COOH} |
| 647 | {Palm} [AC4Abu] [Aeea] [Aeea] q R P [NMeArg] [Cha] S H K G [Pip] [Nle] P [BhPhe] {COOH} |

Any of fatty acyl groups in the specific peptide conjugates listed in Table 7 can be substituted with another fatty acyl group, such as those listed in Table 6. By way of example, a TDA fatty acyl group in any of the specific peptides listed above can be substituted with an HDA, ODDA, or other fatty acyl group. In some embodiments, a fatty acyl group with a shorter carbon chain may be substituted for a fatty acyl group with a longer carbon chain in the peptide-conjugates listed above. For instance, a butanoyl or hexanoyl group may be substituted for a palmitoyl, TDA, HDA, or ODDA fatty acyl group. In other embodiments, the fatty acyl group in the specific peptide conjugates listed in Table 7 may be substituted with another half-life extending moiety (e.g., PEG or an immunoglobulin Fc) as described herein. In alternative embodiments, any of the apelin peptide portions of the conjugates may be used as APJ agonists in an unconjugated form.

In certain embodiments, the half-life extension moiety or vehicle is a polymer. Thus, any of the modified apelin polypeptides disclosed herein can be conjugated, optionally through a conjugation linker, to a polymer, particularly a water-soluble polymer. In some embodiments, the polymer half-life extending moiety is a polyethylene glycol (PEG) polymer, covalently linked, optionally through a conjugation linker, at the N-terminus, C-terminus or at one or more intercalary side chains of the apelin polypeptide. In some embodiments, the peptide conjugate may include one or more PEG moieties conjugated to a non-PEG half-life extending moiety or to the apelin polypeptide, or to any combination of any of these. For example, an immunoglobulin or immunoglobulin Fc domain or portion thereof can be made mono-PEGylated, di-PEGylated, or otherwise multi-PEGylated, by the process of covalent conjugation, and the apelin polypeptide may conjugated to the immunoglobulin or immunoglobulin Fc domain via the one or more PEG moieties.

Covalent conjugation of proteins and peptides with PEG can significantly extend the in vivo circulating half-lives. PEGylation is believed to achieve this effect predominately by retarding renal clearance, since the PEG moiety adds considerable hydrodynamic radius to the molecule (see Zalipsky et al., "Use of functionalized poly(ethylene glycol)s for modification of polypeptides, in poly(ethylene glycol) chemistry: Biotechnical and biomedical applications", J. M. Harris, Ed., Plenum Press: New York, 347-370, 1992). Additional benefits often conferred by PEGylation of proteins and peptides include increased solubility, resistance to proteolytic degradation, and reduced immunogenicity of the therapeutic polypeptide. The merits of protein PEGylation are evidenced by the commercialization of several PEGylated proteins including PEG-Adenosine deaminase (Adagen™/Enzon Corp.), PEG-L-asparaginase (Oncaspar™/Enzon Corp.), PEG-Interferon α-2b (PEG-Intron™/Schering/Enzon), PEG-Interferon α-2a (PEGASYS™/Roche) and PEG-G-CSF (Neulasta™/Amgen) as well as many others in clinical trials.

By "PEGylated peptide," "PEGylated polypeptide" or "PEGylated protein" is meant a peptide having a polyethylene glycol (PEG) moiety covalently bound to an amino acid residue of the peptide itself or to a peptidyl or non-peptidyl linker that is covalently bound to a residue of the peptide, either directly or indirectly through another linker moiety. A non-limiting example is N-terminal conjugation of the peptide with 3-(1-(1-bromo-2-oxo-6,9,12,15,18,21,24,27,30,33,36-undecaoxa-3-azaoctatriacontan-38-yl)-1H-1,2,3-triazol-4-yl)propanoyl (designated herein by the abbreviation "{bromoacetamide-PEG11-triazole}-").

By "polyethylene glycol" or "PEG" is meant a polyalkylene glycol compound or a derivative thereof, with or without coupling agents or derivatization with coupling or activating moieties (e.g., with aldehyde, hydroxysuccinimidyl, hydrazide, thiol, triflate, tresylate, azirdine, oxirane, orthopyridyl disulphide, vinylsulfone, iodoacetamide or a maleimide moiety). In accordance with various embodiments, useful PEG includes substantially linear, straight chain PEG, branched PEG (brPEG), or dendritic PEG. See, e.g., U.S. Pat. Nos. 5,171,264; 5,932,462; 6,602,498.

Briefly, the PEG groups can generally be attached to the peptide portion of the composition via acylation or alkylation (or reductive amination) through a reactive group on the PEG moiety (e.g., an aldehyde, amino, thiol, or ester group) to a reactive group on the compound (e.g., an aldehyde, amino, or ester group). A useful strategy for the PEGylation of synthetic peptides consists of combining, through forming a conjugate linkage in solution, a peptide and a PEG moiety, each bearing a special functionality that is mutually reactive toward the other. The peptides can be easily prepared with conventional solid phase synthesis. The peptides can be "preactivated" with an appropriate functional group at a specific site. The precursors are purified and fully characterized prior to reacting with the PEG moiety. Ligation of the peptide with PEG usually takes place in aqueous phase and can be easily monitored by reverse phase analytical HPLC. The PEGylated peptides can be easily purified by preparative HPLC and characterized by analytical HPLC, amino acid analysis and laser desorption mass spectrometry.

PEG is a well-known, water soluble polymer that is commercially available or can be prepared by ring-opening polymerization of ethylene glycol according to methods well known in the art (Sandler and Karo, Polymer Synthesis, Academic Press, New York, 3:138-161). In the application, the term "PEG" is used broadly to encompass any polyethylene glycol molecule, in mono-, bi-, or poly-functional form, without regard to size or to modification at an end of the PEG, and can be represented by the formula:

$X—O(CH_2CH_2O)_n—R,$ where n is 3 to 2300 and X is H or a terminal modification, e.g., a methyl or $C_{1-4}$ alkyl, and R is the reactive moiety used for covalent attachment.

In some embodiments, a PEG can be used that terminates on one end with hydroxy or methoxy, i.e., X is H or $CH_3$ ("methoxy PEG"). It is noted that the other end of the PEG, which is shown in the formula above terminating in R, covalently attaches to an activating moiety via an ether oxygen bond, an amine linkage, or amide linkage. When used in a chemical structure, the term "PEG" includes the formula above without the hydrogen of the hydroxyl group shown, leaving the oxygen available to react with a free carbon atom of a linker to form an ether bond. More specifically, in order to conjugate PEG to a peptide, the peptide must be reacted with PEG in an "activated" form. Activated PEG can be represented by the formula:

(PEG)-(A)

where PEG (defined supra) covalently attaches to a carbon atom of the activation moiety (A) to form an ether bond, an amine linkage, or amide linkage, and (A) contains a reactive group which can react with an amino, azido, alkyne, imino, maleimido, N-succinimidyl, carboxyl, aminooxy, seleno, or thiol group on an amino acid residue of a peptide or a linker moiety covalently attached to the apelin peptide.

Figure 2:
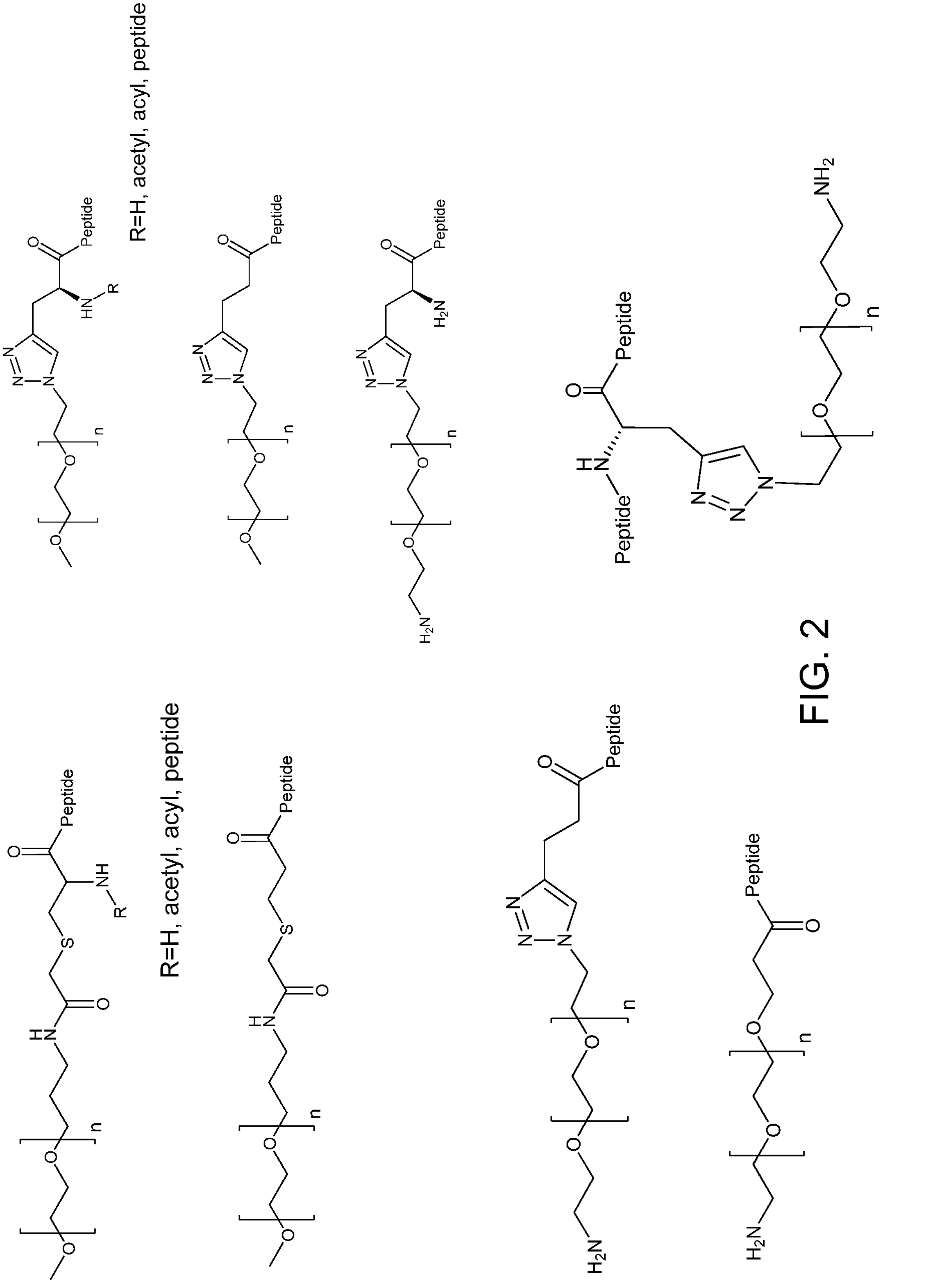
FIG. 2. Examples of PEG groups and linker groups that can be attached to apelin polypeptides of the invention.

Examples of various PEG moieties are shown below and in FIG. 2.

Aminoalkyl PEG $X—(CH_2CH_2O)_n—(CH_2)_n—NH_2$

Thiol PEG $X—(CH_2CH_2O)_n—(CH_2)_n—SH$

Carboxylic acid PEG $X—(CH_2CH_2O)_n—(CH_2)_n—CO_2H$

Hydrazide PEG

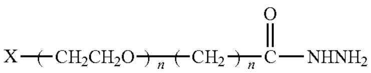

Azido PEG $X—(CH_2CH_2O)_n—(CH_2)_n—N_3$

Mesylate and Tosylate PEGs

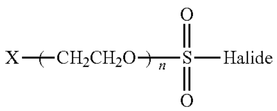

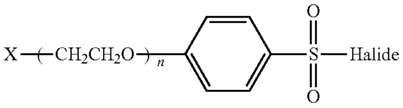

-continued

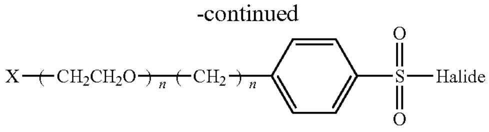

Maleimide PEGs

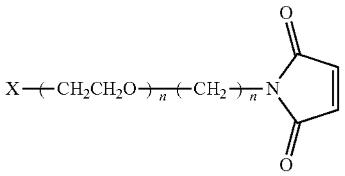

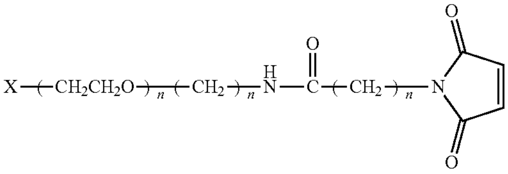

p-Nitrophenyl Carbonate PEG

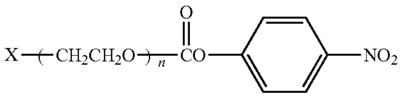

NHS Carbonate PEG

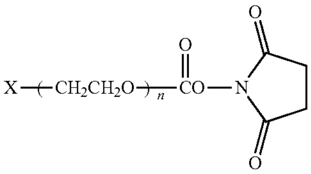

NHS active esters

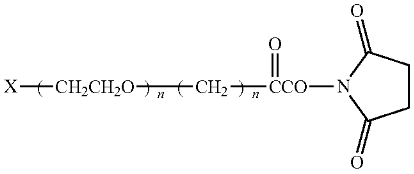

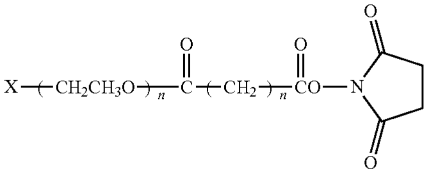

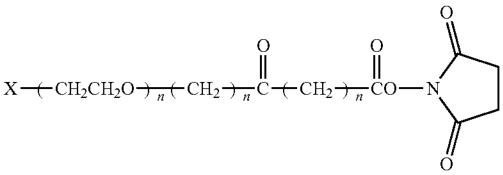

Aldehyde PEG

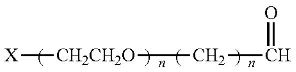

Aminoxy PEGs

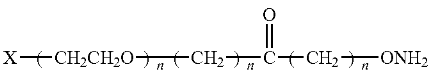

$X—(CH_2CH_2O)_n—(CH_2)_n—ONH_2$

-continued

Iodoacetamide PEG

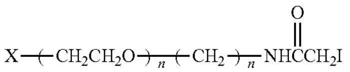

Ortho-pyridyldisulfide PEG

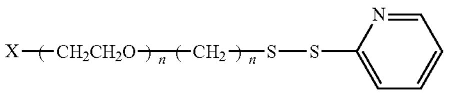

Alkyne PEG

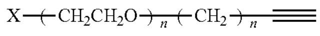

Aeaa ([2-(2-Amino-ethoxy)-ethoxy]-acetic acid) is another PEG that can be used to increase stability of apelin peptides or can serve a spatial, functional, and/or structural role in a conjugation linker of the apelin polypeptide. The structure of Aeea is shown below.

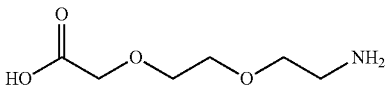 [SMILES: NCCOCCOCC(=O)O]

Techniques for the preparation of activated PEG and its conjugation to biologically active peptides are well known in the art. See, e.g., U.S. Pat. Nos. 5,643,575, 5,919,455, 5,932,462, and 5,990,237, 5,985,265, and 5,824,784; Thompson et al., "PEGylation of polypeptides", EP 0575545 B1; Petit, "Site specific protein modification", U.S. Pat. Nos. 6,451,986, and 6,548,644; S. Herman et al., "Poly(ethylene glycol) with reactive endgroups: I. Modification of proteins", J. Bioactive Compatible Polymers, 10:145-187, 1995; Y. Lu et al., "PEGylated peptides III: Solid-phase synthesis with PEGylating reagents of varying molecular weight: synthesis of multiply PEGylated peptides", Reactive Polymers, 22:221-229, 1994; A. M. Felix et al., "PEGylated Peptides IV: Enhanced biological activity of site-directed PEGylated GRF analogs", Int. J. Peptide Protein Res., 46:253-264, 1995; A. M. Felix, "Site-specific poly(ethylene glycol)ylation of peptides", ACS Symposium Series 680 (poly(ethylene glycol)), 218-238, 1997; Y. Ikeda et al., "Polyethylene glycol derivatives, their modified peptides, methods for producing them and use of the modified peptides", EP 0473084 B1; G. E. Means et al., "Selected techniques for the modification of protein side chains, in: Chemical modification of proteins", Holden Day, Inc., pp. 219, 1971).

Activated PEG, such as PEG-aldehydes or PEG-aldehyde hydrates, can be chemically synthesized by known means or obtained from commercial sources, e.g., Shearwater Polymers, (Huntsville, Al) or Enzon, Inc. (Piscataway, N. J.).

An example of a useful activated PEG can be a PEG-aldehyde compound (e.g., a methoxy PEG-aldehyde), such as PEG-propionaldehyde, which is commercially available from Shearwater Polymers (Huntsville, Al). PEG-propionaldehyde is represented by the formula PEG-$CH_2CH_2CHO$. See, e.g., U.S. Pat. No. 5,252,714. Also included within the meaning of "PEG aldehyde compound" are PEG aldehyde hydrates, e.g., PEG acetaldehyde hydrate and PEG bis aldehyde hydrate, which latter yields a bifunctionally activated structure. See., e.g., Bentley et al., "Poly(ethylene glycol) aldehyde hydrates and related polymers and applications in modifying amines", U.S. Pat. No. 5,990,237. An activated multi-branched PEG-aldehyde compound can be used, for example PEG derivatives comprising multiple arms to give divalent, trivalent, tetravalent, octavalent constructs. Using a 4-arm PEG derivative, four apelin polypeptides can be attached to each PEG molecule. For example, the apelin polypeptide can be conjugated to a polyethylene glycol (PEG) at 1, 2, 3 or 4 amino functionalized sites of the PEG.

In being conjugated, the polyethylene glycol (PEG), as described herein, is covalently bound by alkylation of a thiol present in the peptide or is covalently bound by cycloaddition reaction between azido and alkyne moieties present in the PEG and peptide. Alternatively, the PEG can be covalently bound by reductive amination directly to at least one solvent-exposed free amine moiety of an amino acid residue of the apelin polypeptide itself. In some embodiments, the apelin polypeptide can be conjugated to a PEG at one or more primary or secondary amines on the peptide, or to two PEG groups at a single primary amine site on the peptide (e.g., this can occur when the reductive amination reaction involves the presence of excess PEG-aldehyde compound). It has been observed that when PEGylation by reductive amination is at a primary amine on the peptide, it is not uncommon to have amounts (1 to 100% range) of reaction product that have two or more PEGs present per molecule, and if the desired PEGylation product is one with only one PEG per molecule, then this "over-PEGylation" may be undesirable. When PEGylated product with a single PEG per PEGylation product molecule is desired, an embodiment can be employed that involves PEGylation using secondary amines of the pharmacologically active peptide, because only one PEG group per molecule will be transferred in the reductive amination reaction.

Amino acid residues that can provide a primary amine moiety include residues of lysine, homolysine, ornithine, α, β-diaminopropionic acid (Dap), α, β-diaminopropionoic acid (Dpr), and α, γ-diaminobutyric acid (Dab), aminobutyric acid (Abu), and α-amino-isobutyric acid (Aib). The polypeptide N-terminus also provides a useful α-amino group for PEGylation. Amino acid residues that can provide a secondary amine moiety include ε-N-alkyl lysine, α-N-alkyl lysine, δ-N-alkyl ornithine, α-N-alkyl ornithine, or an N-terminal proline, where the alkyl is $C_1$ to $C_6$.

Another useful activated PEG for generating the PEGylated analogs is a PEG-maleimide compound, such as, but not limited to, a methoxy PEG-maleimide, such as maleimido monomethoxy PEG, are particularly useful for generating PEG-conjugated peptides. (e.g., Shen, "N-maleimidyl polymer derivatives", U.S. Pat. No. 6,602,498; C. Delgado et al., "The uses and properties of PEG-linked proteins", Crit. Rev. Therap. Drug Carrier Systems, 9:249-304, 1992; S. Zalipsky et al., "Use of functionalized poly (ethylene glycol)s for modification of polypeptides, in: Poly(ethylene glycol) chemistry", Biotechnical and Biomedical Applications, J. M. Harris, Ed., Plenum Press: New York, 347-370, 1992; S. Herman et al., "Poly(ethylene glycol) with reactive endgroups: I. Modification of proteins", J. Bioactive Compatible Polymers, 10:145-187, 1995; P. J. Shadle et al., "Conjugation of polymer to colony stimulating factor-1", U.S. Pat. No. 4,847,325; G. Shaw et al., "Cysteine added variants IL-3 and chemical modifications thereof", U.S. Pat. No. 5,166,322 and EP 0469074 B1; G. Shaw et al., "Cysteine added variants of EPO and chemical modifications thereof", EP 0668353 A1; G. Shaw et al., "Cysteine added variants G-CSF and chemical modifications thereof", EP 0668354 A1; N. V. Katre et al., "Interleukin-2 muteins and polymer conjugation thereof", U.S. Pat. No. 5,206,344; R. J. Goodson and N. V. Katre, "Site-directed pegylation of recombinant interleukin-2 at its glycosylation site", Biotechnol., 8:343-346, 1990).

A poly(ethylene glycol) vinyl sulfone is another useful activated PEG for generating the PEG-conjugated apelin polypeptides by conjugation at thiolated amino acid residues, e.g., at C residues. See, e.g., M. Morpurgo et al., "Preparation and characterization of poly(ethylene glycol) vinyl sulfone", Bioconj. Chem., 7:363-368, 1996; see also Harris, "Functionalization of polyethylene glycol for formation of active sulfone-terminated PEG derivatives for binding to proteins and biologically compatible materials", U.S. Pat. Nos. 5,446,090; 5,739,208; 5,900,461; 6,610,281 and 6,894,025; and Harris, "Water soluble active sulfones of poly(ethylene glycol)", WO 95/13312 A1. Another activated form of PEG that is useful in accordance with various embodiments, is a PEG-N-hydroxysuccinimide ester compound, for example, methoxy PEG-N-hydroxysuccinimidyl (NHS) ester. Heterobifunctionally activated forms of PEG are also useful. See, e.g., Thompson et al., "PEGylation reagents and biologically active compounds formed therewith", U.S. Pat. No. 6,552,170.

In some embodiments of producing a PEG-apelin peptide conjugate, the apelin polypeptide is reacted by known chemical techniques with an activated PEG compound, such as but not limited to, a thiol-activated PEG compound, a diol-activated PEG compound, a PEG-hydrazide compound, a PEG-oxyamine compound, or a PEG-bromoacetyl compound. (See, e.g., S. Herman, "Poly(ethylene glycol) with Reactive Endgroups: I. Modification of Proteins", J. Bioactive and Compatible Polymers, 10:145-187, 1995; S. Zalipsky, "Chemistry of Polyethylene Glycol Conjugates with Biologically Active Molecules", Advanced Drug Delivery Reviews, 16:157-182, 1995; R. Greenwald et al., "Poly (ethylene glycol) conjugated drugs and prodrugs: a comprehensive review", Critical Reviews in Therapeutic Drug Carrier Systems, 17:101-161, 2000).

In another embodiment, the activated PEG for generating a PEG-conjugated apelin polypeptide can be a multivalent PEG having more than one activated residues. Multivalent PEG moieties can include, but are not limited to, those shown below in Table 8:

TABLE 8

| Multivalent PEG |
| --- |
| 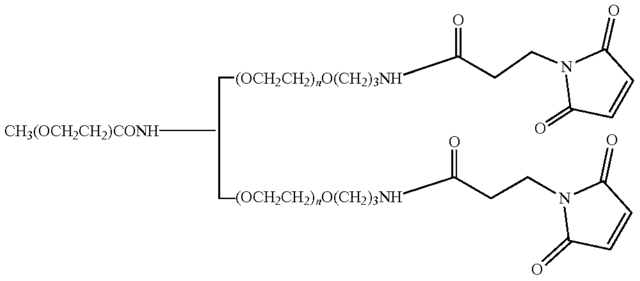 |

TABLE 8-continued
| Multivalent PEG |
| --- |
| 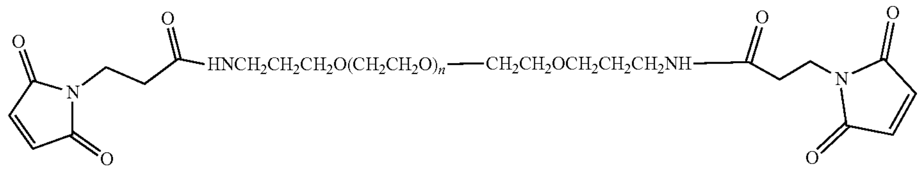 |
| 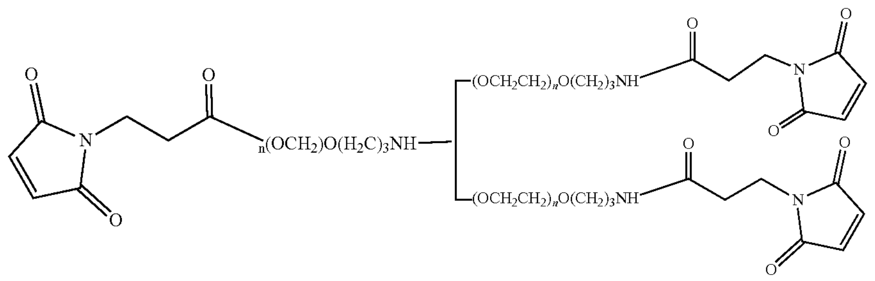 |
| 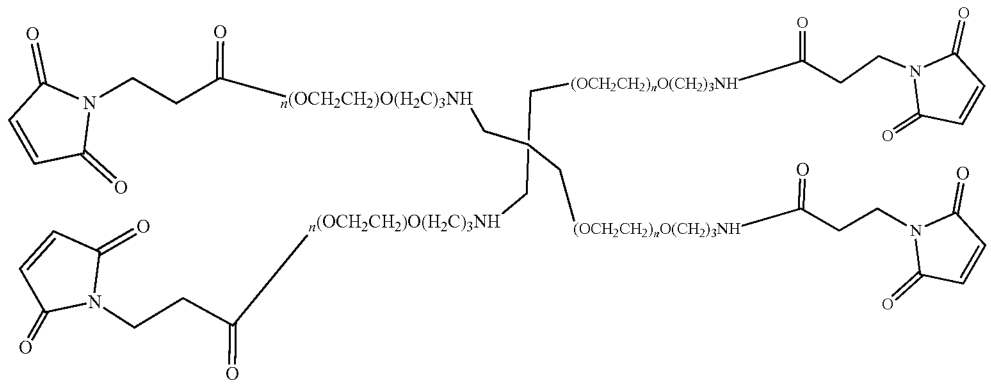 |
| 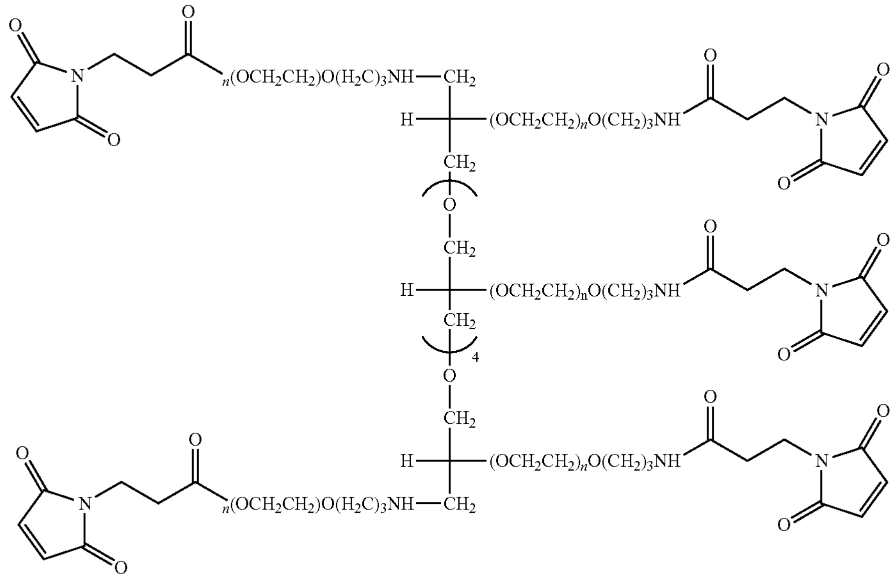 |

TABLE 8-continued

| Multivalent PEG |
| --- |
| 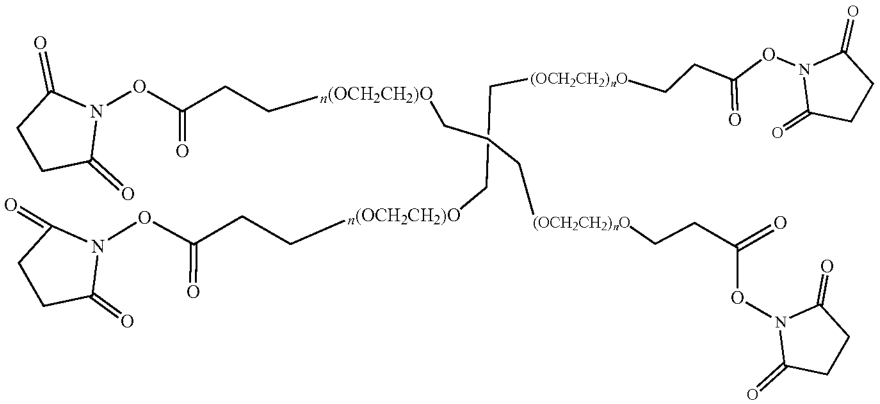 |

In still other embodiments, the apelin polypeptide can be reacted by known chemical techniques with an activated multi-branched PEG compound (PEG derivatives comprising multiple arms to give divalent, trivalent, tetravalent, octavalent constructs), such as but not limited to, pentaerythritol tetra-polyethyleneglycol ether. Functionalization and activated derivatives, such as, but not limited to, N-succinimidyloxycarbonyl)propyl, p-nitrophenyloxycarbonyl, ($-CO_2$-p-$C_6H_4NO_2$), 3-(N-maleimido)propanamido, 2-sulfanylethyl, and 3-aminopropyl. Using a 4-arm PEG derivative, four apelin polypeptides can be attached to each PEG molecule. For example, the apelin polypeptide can be conjugated to a polyethylene glycol (PEG) at:

1, 2, 3 or 4 amino functionalized sites of the PEG;
1, 2, 3 or 4 thiol functionalized sites of the PEG;
1, 2, 3 or 4 maleimido functionalized sites of the PEG;
1, 2, 3 or 4 N-succinimidyl functionalized sites of the PEG;
1, 2, 3 or 4 carboxyl functionalized sites of the PEG;
1, 2, 3 or 4 p-nitrophenyloxycarbonyl functionalized sites of the PEG;
1, 2, 3 or 4 azido functionalized sites of the PEG;
1, 2, 3 or 4 alkene or alkyne functionalized sites of the PEG; or
1, 2, 3 or 4 halide or halide-acetylamide functionalized sites of the PEG.

The smallest practical size of PEG is about 500 Daltons (Da), below which PEG becomes toxic. Above about 500 Da, any molecular mass for a PEG can be used as practically desired, e.g., from about 500 Daltons (Da) to 100,000 Da (n is 10 to 2300). The number of PEG monomers (n) is approximated from the average molecular mass using a MW=44 Da for each monomer. In some embodiments, the combined or total average molecular mass of PEG used in a PEG-conjugated apelin polypeptide can be from about 500 Da to 10,000 Da (total n is from 10 to 230), or from about 10,000 to 40,000 Da (total n is from 230 to 910), or from about 40,000 to 100,000 Da (total n is from 910 to 2300).

In various other embodiments, the combined molecular mass of the PEG molecule should not exceed about 100,000 Da. In some embodiments, the combined or total average molecular mass of PEG used in a PEG-conjugated apelin polypeptide can be from about 3,000 Da to 60,000 Da (total n is from 70 to 1,400), from about 10,000 Da to 40,000 Da (total n is about 230 to about 910). In other embodiments the combined mass for PEG is from about 20,000 Da to 30,000 Da (total n is about 450 to about 680). In one embodiment, the average molecular mass of PEG used in a PEG-conjugated apelin polypeptide is about 5,000 Da (5 kDa). In another embodiment, the average molecular mass of PEG used in a PEG-conjugated apelin polypeptide is about 10,000 Da (10 kDa). In still another embodiment, the average molecular mass of PEG used in a PEG-conjugated apelin polypeptide is about 20,000 Da (20 kDa).

In some embodiments, the PEG polymer is conjugated to the apelin polypeptide through a conjugation linker as described in detail below. In one embodiment, the conjugation linker comprises 3-mercaptopropanoic acid (abbreviated as MerPr herein). In another embodiment, the conjugation linker comprises 3-(1H-1,2,3-triazol-4-yl)propanoic acid (abbreviated as 3TP herein). 3TP results from pent-4-ynoic acid when a PEG azide click reaction is employed for the conjugation. Exemplary PEG-apelin peptide conjugates of the invention are shown in Table 9 below. PEG abbreviations used in Table 9 and elsewhere herein are defined as follows: NPeg11=1-amino-3,6,9,12,15,18,21,24,27,30,33,36-dodecaoxanonatriacontan-39-oic acid; [Pra](NPeg9)=(S)-2-amino-3-(1-(32-amino-3,6,9,12,15,18,21,24,27,30-decaoxadotriacontyl)-1H-1,2,3-triazol-4-yl)propanoic acid; 10K-mPEGacetamideReg, 10K-mPEGReg, or 10K-mPEGacetamide=Methoxypolyethylene glycol amine-N-acetamide (10 kDa); and 20K-mPEGacetamideReg, 20K-mPEGReg, 20K-mPEGacetamide=Methoxypolyethylene glycol amine-N-acetamide (20 kDa). Note that MerPr and 3TP, which are both linkers as defined above, are positioned between the PEG polymer and the amino terminus of the apelin polypeptide even though the linker abbreviation is listed first in the sequences below. In certain embodiments, the modified apelin polypeptide may comprise an amino acid sequence of any one of the peptides listed in Table 9 below.

TABLE 9

| Exemplary PEG-Apelin Peptide Conjugates | |
|---|---|
| SEQ ID NO: | SEQUENCE |
| 96 | {H2}[PE]RP[hArg][Cha][Pra](NPeg9)HKG[Oic][Nle]P[4-Cl—F]{COOH} |
| 97 | [MerPr](20K mPEGacetamide)KFRRQRP[hArg][Cha]SHKG[Oic][Nle]P[4-Cl—F]{COOH} |
| 98 | {H2}[MerPr](20K mPEGacetamide)FRRQRP[hArg][Cha]SHKG[Oic][Nle]P[4-Cl—F]{COOH} |
| 99 | {H2}[MerPr](20K mPEGacetamide)RRQRP[hArg][Cha]SHKG[Oic][Nle]P[4-Cl—F]{COOH} |
| 100 | {H2}[MerPr](20K mPEGacetamide)RQRP[hArg][Cha]SHKG[Oic][Nle]P[4-Cl—F]{COOH} |
| 101 | {H2}[MerPr](20K mPEGacetamide)QRP[hArg][Cha]SHKG[Oic][Nle]P[4-Cl—F}{COOH} |
| 102 | {Npeg11}KFRRQRP[hArg][Cha]SHKG[Oic][Nle]P[4-Cl—F]{COOH} |
| 103 | {H2}[3TP](20K-mPEGReg)[hArg]rQ[hArg]Pr[NMeLeu]SHKG[Oic][pI-Phe]P[D-Bip]{COOH} |
| 104 | {H2}[3TP](20K-mPEGReg)[hArg]RQ[hArg]PR[NMeLeu]SHKG[Oic][pI-Phe]P[D-Bip]{COOH} |
| 105 | {Acetyl}[Atz(20K-mPEGReg)]KFRRQRP[hArg][Cha]SHKG[Oic][Nle]P[4-Cl—F]{COOH} |
| 106 | {Acetyl}[Atz(20K-mPEGReg)]LRP[hArg][Cha]SHKG[Oic][Nle]P[4-Cl—F]{COOH} |
| 107 | {Acetyl-NH}[Pra](20K-mPEGReg)OF[hArg][hArg]QRP[hArg][NMeLeu]SHKG[Oic][pI-Phe]P[D-Bip]{COOH} |
| 108 | {Acetyl-NH}[Pra](20K-mPEGReg)OF[hArg][hArg]QRP[hArg][NMeLeu]SHKG[Oic][pI-Phe]P[pI-Phe]{COOH} |
| 109 | {Acetyl-NH}[NPeg11]QRP[hArg][Cha]SHKG[Oic][Nle]P[4-Cl—F]{COOH} |
| 110 | {H2}[MerPr](10K mPEGacetamide)QRPRLSHKGPMPF{COOH} |
| 111 | {H2}[MerPr](10KmPEGacetamide)q[hArg]P[NMeArg][Cha]SHKG[Oic][Nle]P[D-4ClF]{COOH} |
| 112 | {H2}[MerPr](10KmPEGacetamide)Q[hArg]P[NMeArg][aMeLeu]SHKGP[Nle]P[4-Cl—F]{COOH} |
| 113 | {H2}[MerPr](10KmPEGacetamide)Q[hArg]P[NMehArg]LSHKGP[Nle]P[4-Cl—F]{COOH} |
| 114 | {H2}[MerPr](10KmPEGacetamide)QR[aMePro][hArg][aMeLeu]SHKGP[Nle]P[4-Cl—F]{COOH} |
| 115 | {H2}[MerPr](10KmPEGacetamide)QRP[NMeArg]LSHKGP[Nle]P[4-Cl—F]{COOH} |
| 116 | {H2}[MerPr](10KmPEGacetamide)Q[NMehArg]P[NMeArg][aMeLeu]SHKGP[Nle]P[4-Cl—F]{COOH} |
| 117 | {H2}[MerPr](10KmPEGacetamide)QRP[hArg][aMeLeu]SHKGP[Nle]P[4-Cl—F]{COOH} |
| 119 | {H2}[MerPr](10KmPEGacetamide)QrP[hArg][aMeLeu]SHKGP[Nle]P[4-Cl—F]{COOH} |
| 120 | {H2}[MerPr](10KmPEGacetamide)QRP[NMeArg][Cha]SHKG[Oic][Nle][Aib][4-Cl—F]{COOH} |

In certain embodiments of the invention, the half-life extension moiety or vehicle is an immunoglobulin or immunoglobulin Fc domain, particularly a human immunoglobulin or human immunoglobulin Fc domain (e.g. IgG1, IgG2, IgG3 or IgG4). Thus, any of the modified apelin polypeptides disclosed herein can be conjugated, optionally through a conjugation linker, to an immunoglobulin or immunoglobulin Fc domain. In embodiments in which the conjugation linker is present, the conjugation linker may be a peptidyl or non-peptidyl linker. In certain embodiments, the non-peptidyl linker comprises a PEG polymer.

The term "immunoglobulin" encompasses full antibodies comprising two dimerized heavy chains (HC), each covalently linked to a light chain (LC); a single undimerized immunoglobulin heavy chain and covalently linked light chain (HC+LC); or a chimeric immunoglobulin (light chain+heavy chain)-Fc heterotrimer (a so-called "hemibody"). An "Fc region", or used interchangeably herein, "Fc domain" or "immunoglobulin Fc domain," contains two heavy chain fragments, which can comprise the $CH_1$, $CH_2$, and $CH_3$ domains of a HC of an antibody. In some embodiments, the Fc domain comprises the immunoglobulin $CH_2$ and $CH_3$ domains, but not the $CH_1$ domain. The two heavy chain fragments of an Fc domain are held together by two or more disulfide bonds and by hydrophobic interactions of the $CH_3$ domains.

Recombinant fusion or chemical conjugation of the apelin polypeptides of the invention to a recombinant immunoglobulin or immunoglobulin Fc domain of any of the IgG1, IgG2, IgG3 or IgG4 isotypes can be useful to extend pharmacokinetic half-life. See, e.g., WO 2010/108153A2. Any of the carrier immunoglobulins or Fc domains thereof disclosed in WO 2010/108153 A2 or WO/2012/040518, or isotype conversions of any of them comprising different isotype constant domains, or other carrier immunoglobulins known in the art, can be used as half-life extending moieties within the scope of the invention. For example, aglycosylated (e.g., N297G variant IgG1; WO 2012/075037 A1) and/or cysteine-substituted ("CysMab") variant immunoglobulin Fc monomers can also be employed for enhanced stability or modified effector function. See, e.g., WO2007/022070 A2, which is hereby incorporated by reference in its entirety.

One example of a human IgG2 heavy chain (HC) constant domain that can be used to produce an immunoglobulin or Fc domain half-life extension moiety has the amino acid sequence:

(SEQ. ID NO: 729)
ASTKGPSVFPLAPCSRSTSESTAALGCLVKDYFPEPVTVSWNSGALTSGV

HTFPAVLQSSGLYSLSSVVTVPSSNFGTQTYTCNVDHKPSNTKVDKTVER

KCCVECPPCPAPPVAGPSVFLFPPKPKDTLMISRTPEVTCVVVDVSHEDP

EVQFNWYVDGVEVHNAKTKPREEQFNSTFRVVSVLTVVHQDWLNGKEYKC

KVSNKGLPAPIEKTISKTKGQPREPQVYTLPPSREEMTKNQVSLTCLVKG

FYPSDIAVEWESNGQPENNYKTTPPMLDSDGSFFLYSKLTVDKSRWQQGN

VFSCSVMHEALHNHYTQKSLSLSPGK.

Constant region sequences of other IgG isotypes are known in the art for an IgG1, IgG2, IgG3, or IgG4 immunoglobulin isotype, if desired. In general, human IgG2 can be used for targets where effector functions are not desired, and human IgG1 in situations where such effector functions (e.g., antibody-dependent cytotoxicity (ADCC)) are desired. Human IgG3 has a relatively short half-life and human IgG4 forms antibody "half-molecules." There are four known allotypes of human IgG1. The preferred allotype is referred to as "hIgG1z", also known as the "KEEM" allotype. Human IgG1 allotypes "hIgG1za" (KDEL), "hIgG1f" (REEM), and "hIgG1fa" are also useful; all appear to have ADCC effector function.

Human hIgG1z heavy chain (HC) constant domain has the amino acid sequence:

(SEQ ID NO: 730)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

Human hIgG1za heavy chain (HC) constant domain has the amino acid sequence:

(SEQ ID NO: 731)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKKVEP

LGGPSVFLFPPKPKDTLMISRTPEVTCVVVDVSHEDPEVKFNWYVDGVEV

HNAKTKPKSCDKTHTCPPCPAPELREEQYNSTYRVVSVLTVLHQDWLNGK

EYKCKVSNKALPAPIEKTISKAKGQPREPQVYTLPPSRDELTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

Human hIgG1f heavy chain (HC) constant domain has the amino acid sequence:

(SEQ ID NO: 732)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

Human hIgG1fa heavy chain (HC) constant domain has the amino acid sequence:

(SEQ ID NO: 733)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGK

EYKCKVSNKALPAPIEKTISKAKGQPREPQVYTLPPSRDELTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In some embodiments of the invention, the half-life extending moiety is an immunoglobulin Fc domain (e.g., a human immunoglobulin Fc domain, including Fc of allotype IgG1, IgG2, IgG3 or IgG4) or a portion thereof (e.g., $CH_2$ domain of the Fc domain). The Fc domain may comprise the sequence of any one of SEQ ID NOs: 716 and 729-733. In one embodiment, the Fc domain to which an apelin polypeptide of the invention is conjugated comprises the amino acid sequence of SEQ ID NO: 716.

Monovalent dimeric or bivalent dimeric Fc-apelin peptide fusions or conjugates are useful embodiments of the peptide conjugates of the invention. A "monovalent dimeric" Fc-apelin peptide fusion or conjugate, or interchangeably, "monovalent dimer," or interchangeably, "monovalent heterodimer," is an Fc-apelin peptide analog fusion or conjugate that includes an apelin peptide conjugated with only one of the dimerized Fc domains. A "bivalent dimeric" Fc-apelin peptide analog fusion, or interchangeably, "bivalent dimer" or "bivalent homodimer," is a Fc-apelin peptide fusion or conjugate having both of the dimerized Fc domains each conjugated separately with an apelin peptide analog.

Immunoglobulin Fc domains include Fc variants, which are suitable half-life extending moieties within the scope of this invention. A native Fc can be extensively modified to form an Fc variant in accordance with this invention, provided binding to the salvage receptor is maintained; see, for example WO 97/34631, WO 96/32478, and WO 04/110472. In such Fc variants, one can remove one or more sites of a native Fc that provide structural features or functional activity not required by the fusion or conjugate molecules of this invention. One can remove these sites by, for example, substituting or deleting residues, inserting residues into the site, or truncating portions containing the site. The inserted or substituted residues can also be altered amino acids, such as peptidomimetics or D-amino acids. Fc variants can be desirable for a number of reasons, several of which are described below. Exemplary Fc variants include molecules and sequences in which:

1. Sites involved in disulfide bond formation are removed. Such removal can avoid reaction with other cysteine-containing proteins present in the host cell used to produce the molecules of the invention. For this purpose, the cysteine-containing segment at the N-terminus can be truncated or cysteine residues can be deleted or substituted with other amino acids (e.g., alanyl, seryl). Even when cysteine residues are removed, the single chain Fc domains can still form a dimeric Fc domain that is held together non-covalently.

2. A native Fc is modified to make it more compatible with a selected host cell. For example, one can remove the PA dipeptide sequence near the N-terminus of a typical native Fc, which can be recognized by a digestive enzyme in *E. coli* such as proline iminopeptidase. One can also add an N-terminal methionine residue, especially when the molecule is expressed recombinantly in a bacterial cell such as *E. coli.*

3. A portion of the N-terminus of a native Fc is removed to prevent N-terminal heterogeneity when expressed in a selected host cell. For this purpose, one can delete any of the first 20 amino acid residues at the N-terminus, particularly those at positions 1, 2, 3, 4 and 5.

4. One or more glycosylation sites are removed. Residues that are typically glycosylated (e.g., asparagine) can confer cytolytic response. Such residues can be deleted or substituted with unglycosylated residues (e.g., alanine).

5. Sites involved in interaction with complement, such as the C1q binding site, are removed. For example, one can delete or substitute the EKK tripeptide sequence of human IgG1. Complement recruitment may not be advantageous for the molecules of this invention and so can be avoided with such an Fc variant.

6. Sites are removed that affect binding to Fc receptors other than a salvage receptor. A native Fc can have sites for interaction with certain white blood cells that are not required for the fusion or conjugate molecules of the present invention and so can be removed.

7. The ADCC site is removed to decrease or eliminate ADCC effector function, or alternatively, modified for enhanced ADCC effector function by non-fucosylation or de-fucosylation. ADCC sites are known in the art; see, for example, Molec. Immunol. 29(5): 633-9, 1992, with regard to ADCC sites in IgG1. These sites, as well, are not required for the fusion or conjugate molecules of the present invention and so can be removed, or enhanced for ADCC effector function, as may be desired. See, Iida et al., Two mechanisms of the enhanced antibody-dependent cellular cytotoxicity (ADCC) efficacy of non-fucosylated therapeutic antibodies in human blood, BMC Cancer 9:58, 2009, doi: 10.1186/1471-2407-9-58.

8. When the native Fc is derived from a non-human antibody, the native Fc can be humanized. Typically, to humanize a native Fc, one will substitute selected residues in the non-human native Fc with residues that are normally found in human native Fc. Techniques for antibody humanization are well known in the art.

9. A peptidyl or non-peptidyl linker of suitable length and neutral charge, such as those described in more detail below can be covalently fused between N-terminus of the apelin polypeptide of the invention and the C-terminus, N-terminus, or an internal residue of an Fc domain. In some embodiments, the Fc domain can be engineered to include an internal residue (such as a cysteine residue) to which the apelin polypeptide may be conjugated (see Example 11). Other engineered Fc domains that can be used in the Fc-apelin peptide conjugates are described in WO2007/022070 A2, which is hereby incorporated by reference in its entirety. For purposes of the invention, a variant Fc domain can also be part of a monomeric immunoglobulin heavy chain, an antibody, or a heterotrimeric hemibody (LC+HC+Fc).

It will be appreciated that "multimers" of the peptide conjugates can be made, since the half-life extending moiety employed for conjugation of the apelin polypeptide (with or without an intervening linker moiety) can be multivalent (e.g., bivalent, trivalent, tetravalent or a higher order valency) as to the number of amino acid residues at which the half-life extending moiety can be conjugated. In some embodiments, the peptide can be multivalent (e.g., bivalent, trivalent, tetravalent or a higher order valency), and, thus, some "multimers" may have more than one half-life extending moiety. Consequently, it is possible to produce a variety of conjugated half-life extending moiety peptide structures. By way of example, a univalent half-life extending moiety and a univalent peptide can produce a 1:1 conjugate; a bivalent peptide and a univalent half-life extending moiety may form conjugates wherein the peptide conjugates bear two half-life extending moiety moieties, whereas a bivalent half-life extending moiety and a univalent peptide may produce species where two peptide entities are linked to a single half-life extending moiety; use of higher-valence half-life extending moiety can lead to the formation of clusters of peptide entities bound to a single half-life extending moiety, whereas higher-valence peptides may become encrusted with a plurality of half-life extending moiety moieties. By way of further example, if the site of conjugation of a multivalent half-life extending moiety to the apelin polypeptide is a cysteine or other aminothiol, the methods disclosed by D'Amico et al. may be employed (D'Amico et al., "Method of conjugating aminothiol containing molecules to vehicles", published as U.S. Patent Publication No. 2006/0199812, which application is incorporated herein by reference in its entirety).

The peptide moieties may have more than one reactive group which will react with the activated half-life extending moiety and the possibility of forming complex structures must always be considered; when it is desired to form simple structures such as 1:1 adducts of half-life extending moiety and peptide, or to use bivalent half-life extending moiety to form peptide:half-life extending moiety:peptide adducts, it will be beneficial to use predetermined ratios of activated half-life extending moiety and peptide material, predetermined concentrations thereof and to conduct the reaction under predetermined conditions (such as duration, temperature, pH, etc.) so as to form a proportion of the described product and then to separate the described product from the other reaction products. The reaction conditions, proportions and concentrations of the reagents can be obtained by relatively simple trial-and-error experiments which are within the ability of an ordinarily skilled artisan with appropriate scaling-up as necessary. Purification and separation of the products is similarly achieved by conventional techniques well known to those skilled in the art.

Additionally, physiologically acceptable salts of the half-life extending moiety-fused or conjugated to the apelin polypeptide are also encompassed by various embodiments described within.

The above-described half-life extending moieties and other half-life extending moieties described herein are useful, either individually or in combination, and as further described in the art, for example, in U.S. Patent Publication No. 2007/0071764 and WO 2008/088422, which are both incorporated herein by reference in their entireties. Various embodiments encompass the use of any single species of pharmaceutically acceptable half-life extending moiety, such as, but not limited to, those described herein, in conjugation with the apelin polypeptides, or the use of a combination of two or more like or different half-life extending moieties.

The modified apelin polypeptides of the invention may, in some embodiments, be conjugated or attached to a half-life extension moiety through a conjugation linker. The linker, e.g., may consist of a thioether, amine, imine, amide, triazole, disulfide, or a carbon-carbon bond. Thus, in various embodiments, e.g. a thioether can tether the vehicle or half-life extension moiety to the apelin polypeptide. In certain embodiments, the conjugation linker, when present, comprises Aeea, Aeea-Aeea, γGlu-Aeea, γGlu-Aeea-Aeea, or γGlu. See, e.g. Example 2 herein.

The conjugation linker or linker moiety can be a biologically acceptable peptidyl or non-peptidyl organic group that is covalently bound to an amino acid residue of an apelin polypeptide or other polypeptide chain (e.g., an immunoglobulin heavy chain or light chain or immunoglobulin Fc domain) contained in a composition, which linker moiety covalently joins or conjugates the apelin polypeptide or other polypeptide chain to another peptide or polypeptide chain in the composition, or to a half-life extending moiety. In some embodiments, a half-life extending moiety, as described herein, is conjugated, i.e., covalently bound directly to an amino acid residue of the apelin polypeptide itself, or optionally, to a peptidyl or non-peptidyl linker moiety (including but not limited to aromatic or aryl linkers) that is covalently bound to an amino acid residue of the apelin polypeptide.

In some embodiments, the presence of a linker moiety can be useful in optimizing pharmacological activity of the peptide conjugates. The linker may be made up of amino acids linked together by peptide bonds. The linker moiety, if present, can be independently the same or different from any other linker, or linkers, that may be present in the composition. As stated above, the linker moiety, if present (whether within the primary amino acid sequence of the apelin peptide, or as a linker for attaching a half-life extending moiety to the apelin peptide), can be "peptidyl" in nature (i.e., made up of amino acids linked together by peptide bonds) and made up in length, preferably, of from 1 up to about 40 amino acid residues, of from 1 up to about 20 amino acid residues, or from 1 to about 10 amino acid residues. The amino acid residues in the linker are from among the twenty canonical amino acids, e.g., cysteine, glycine, alanine, proline, asparagine, glutamine, and/or serine. In various embodiments, a peptidyl linker can be made up of a majority of amino acids that are sterically unhindered, such as glycine, serine, and alanine linked by a peptide bond. It may also be desirable that, if present, a peptidyl linker be selected that avoids rapid proteolytic turnover in circulation in vivo. Some of these amino acids may be glycosylated, as is well understood by those in the art. For example, a useful linker sequence constituting a sialylation site is $X_1X_2NX_4X_5G$ (SEQ ID NO: 734), wherein $X_1$, $X_2$, $X_4$ and $X_5$ are each independently any amino acid residue. It may also be desirable that, if present, a peptidyl linker can consist of any non-canonical amino acids or a combination of non-canonical and canonical amino acids selected to avoid or reduce rapid proteolytic turnover in vitro and/or in vivo.

In other embodiments, the 1 to 40 amino acids of the peptidyl linker moiety can be selected from glycine, alanine, proline, asparagine, glutamine, and lysine. A linker can be made up of a majority of amino acids that are sterically unhindered, such as glycine and alanine. Thus, linkers can include polyglycines, polyserines, and polyalanines, or combinations of any of these. Some exemplary peptidyl linkers are poly$(Gly)_{1-8}$, particularly $(Gly)_3$ (SEQ ID NO: 735), $(Gly)_4$ (SEQ ID NO: 736), $(Gly)_5$ (SEQ ID NO: 737) and $(Gly)_7$ (SEQ ID NO: 738), as well as, poly glycine-serine linkers, such as "L15" (GGGGSGGGGSGGGGS; SEQ ID NO: 739), poly glycine-alanine and polyalanine linkers. Other specific examples of peptidyl linkers include $(Gly)_5$ Lys (SEQ ID NO: 740), and $(Gly)_5$LysArg (SEQ ID NO: 741). Other examples of useful peptidyl linkers are: $(Gly)_3$ Lys$(Gly)_4$ (SEQ ID NO: 742); $(Gly)_3$AsnGlySer$(Gly)_2$ (SEQ ID NO: 743); $(Gly)_3$Cys$(Gly)_4$ (SEQ ID NO: 744); and GlyProAsnGlyGly (SEQ ID NO: 745).

To explain the above nomenclature, for example, $(Gly)_3$ Lys$(Gly)_4$ (SEQ ID NO: 742) means Gly-Gly-Gly-Lys-Gly-Gly-Gly-Gly (SEQ ID NO:742). Other combinations of Gly and Lys or Gly and Ala are also useful.

Other linkers are those identified herein as "L5" (GGGGS; or "$G_4S$"; SEQ ID NO: 746), "L10" (GGGGSGGGGS; SEQ ID NO: 747); "L20" (GGGGSGGGGSGGGGSGGGGS; SEQ ID NO: 748); "L25" (GGGGSGGGGSGGGGSGGGGSGGGGS; SEQ ID NO: 749) and any linkers used in the working examples hereinafter.

In some embodiments which comprise a peptide linker moiety, acidic residues, for example, glutamate or aspartate residues are placed in the amino acid sequence of the linker moiety. Examples include the following peptide linker sequences:

```
                                    (SEQ ID NO: 750)
GGEGGG;

                                    (SEQ ID NO: 751)
GGEEEGGG;
```

-continued (SEQ ID NO: 752)
GEEEG;

(SEQ ID NO: 753)
GEEE;

(SEQ ID NO: 754)
GGDGGG;

(SEQ ID NO: 755)
GGDDDGG;

(SEQ ID NO: 756)
GDDDG;

(SEQ ID NO: 757)
GDDD;

(SEQ ID NO: 758)
GGGGSDDSDEGSDGEDGGGGS;

(SEQ ID NO: 759)
WEWEW;

(SEQ ID NO: 760)
FEFEF;

(SEQ ID NO: 761)
EEEWWW;

(SEQ ID NO: 762)
EEEFFF;

(SEQ ID NO: 763)
WWEEEWW;
or (SEQ ID NO: 764)
FFEEEFF.

The linkers shown here are exemplary; peptidyl linkers may be much longer and may include other residues. A peptidyl linker can contain, e.g., a cysteine, another thiol, or nucleophile for conjugation with a half-life extending moiety. In another embodiment, the linker can contain a cysteine or homocysteine residue, or other 2-amino-ethanethiol or 3-amino-propanethiol moiety for conjugation to maleimide, iodoacetamide or thioester, functionalized half-life extending moiety.

Another useful peptidyl linker is a large, flexible linker comprising a random Gly/Ser/Thr sequence, for example: GSGSATGGSGSTASSGSGSATH (SEQ ID NO: 765) or HGSGSATGGSGSTASSGSGSAT (SEQ ID NO: 766), which is estimated to be about the size of a 1 kDa PEG molecule. Alternatively, a useful peptidyl linker may be comprised of amino acid sequences known in the art to form rigid helical structures (e.g., Rigid linker: -AEAAAKEAAAKEAAAKAGG (SEQ ID NO: 767). Additionally, a peptidyl linker can also comprise a non-peptidyl segment such as a 6 carbon aliphatic molecule of the formula $—CH_2—CH_2—CH_2—CH_2—CH_2—CH_2—$. The peptidyl linkers can be altered to form derivatives as described herein.

A non-peptidyl linker moiety is also useful for conjugating the half-life extending moiety to the apelin peptide. For example, alkyl linkers such as $—NH—(CH_2)_s—C(O)—$, wherein s=2-20 can be used. These alkyl linkers may further be substituted by any non-sterically hindering group such as lower alkyl (e.g., $C_1$-$C_6$) lower acyl, halogen (e.g., Cl, Br), CN, $NH_2$, phenyl, etc. Exemplary non-peptidyl linkers are PEG linkers (e.g., shown below):

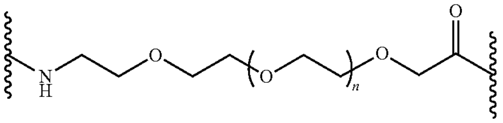

wherein n is such that the linker has a molecular weight of about 100 to about 5000 Daltons (Da). In certain embodiments, the non-peptidyl linker is bromoacetyl-NPeg11 as illustrated in Example 11 for an Fc-apelin peptide conjugate.

The linker could also be an unnatural amino acid, such as aminohenxanoic acid, or an organic group, such as a dicarbohylic acid, such as succinic acid (butanedioic acid).

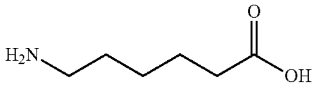
6-aminohexanoic acid

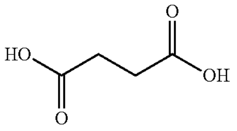
butanedioic acid

In one embodiment, the non-peptidyl linker is aryl. The linkers may be altered to form derivatives in the same manner as described herein. In addition, PEG moieties may be attached to the N-terminal amine or selected side chain amines by either reductive alkylation using PEG aldehydes or acylation using hydroxysuccinimido or carbonate esters of PEG, or by thiol conjugation.

"Aryl" is phenyl or phenyl vicinally-fused with a saturated, partially-saturated, or unsaturated 3-, 4-, or 5 membered carbon bridge, the phenyl or bridge being substituted by 0, 1, 2 or 3 substituents selected from $C_{1-8}$ alkyl, $C_{1-4}$ haloalkyl or halo. "Heteroaryl" is an unsaturated 5, 6 or 7 membered monocyclic or partially-saturated or unsaturated 6-, 7-, 8-, 9-, 10- or 11 membered bicyclic ring, wherein at least one ring is unsaturated, the monocyclic and the bicyclic rings containing 1, 2, 3 or 4 atoms selected from N, O and S, wherein the ring is substituted by 0, 1, 2 or 3 substituents selected from $C_{1-8}$ alkyl, $C_{1-4}$ haloalkyl and halo. Non-peptide portions, such as non-peptidyl linkers or non-peptide half-life extending moieties can be synthesized by conventional organic chemistry reactions.

The above is merely illustrative and not an exhaustive treatment of the kinds of linkers that can optionally be employed in accordance with various embodiments of the half-life extension-apelin peptide conjugates of the invention.

As an additional strategy to increase the stability of apelin polypeptides, polypeptides can be prepared in which a covalent bond joins any two atoms present in the polypeptide to form a cyclic structure. $X_n$ and $X_{n+3}$ or $X_n$ and $X_{n+4}$ are independently a natural or unnatural amino acid selected from K, D, Orn, Dab or E in either D- or L-stereochemistry where the side chains of the amino acids at these positions are covalently linked together forming an amide bond (—NHC(O)— or —C(O)—NH—). The amide bond may be formed directly via the side chain amino and carboxyl functional groups or with a diamino, bis-carboxyl, or amino-carboxyl linker forming the amide bonds. Alternatively, the amide bond can be replaced with either a monosulfide (—S—), a disulfide (—S—S—) or a linkage of Formula $—S—CH_2—C(=Z)—CH_2—S—$; wherein Z is O, N—O—$CH_2C(O)$— to accomplish cyclization. In some embodiments, the cyclic apelin polypeptides are conjugated to a half-life extension moiety to further enhance the stability of the peptides and/or modulate the pharmacokinetic profile of the peptides.

In one embodiment, a modified apelin polypeptide of the invention can be described by the following formula:

$N_1$[AC4Abu]$N_2$X, wherein: $N_1$ is a fatty acyl group or Acetyl-NH, $N_2$ is [Aeea][Aeea] or [Aeea], and X is an apelin polypeptide of 11, 12, 13, 14, 15, 16 or 17 amino acids long comprising E1xxK1 (cyclized via an amide bond between E and K) wherein xx is 2-3 amino acids selected from D- or L-amino acids, α- or β-amino acids, homologated amino acids, N-methylated amino acids, α-methyl amino acids, amino acids bearing the side chain on N instead of the α-carbon or another canonical or a non-canonical amino acid.

In another embodiment, a modified apelin polypeptide of the invention can be described by the following formula:

[Z]$X_1X_2X_3X_4X_5X_6X_7X_8X_9X_{10}X_{11}X_{12}$ $X_{13}PX_{14}$ (SEQ ID NO: 768) having only one amide bond between the carboxylate side chain of E and the amino sidechain of K and wherein: Z is acetyl, acyl, [Atz(PEG10)], a PEG derivative, {TDA}[AC4Abu][Aeea][Aeea], or other half-life extension moiety or is absent; $X_1$ is r, [hArg], [NmeArg], R, absent, or E and if $X_1$ is E its carboxylate sidechain forms an amide bond with the sidechain of a K at position $X_4$ or $X_5$; $X_2$ is r, [hArg], [NmeArg], R, absent, or E and if $X_2$ is E its carboxylate sidechain forms an amide bond with the sidechain of a K at position $X_5$ or $X_6$; $X_3$ is Q, q, or E and if $X_3$ is E its carboxylate sidechain forms an amide bond with the sidechain of a K at position $X_6$ or $X_7$; $X_4$ is r, [hArg], [NmeArg], R, K or E and if $X_4$ is E its carboxylate sidechain forms an amide bond with the sidechain of a K at position $X_7$ or $X_8$, or if $X_4$ is K its amine sidechain forms an amide bond with the sidechain of E at position $X_1$; $X_5$ is P, K or E and if $X_5$ is E its carboxylate sidechain forms an amide bond with the sidechain of a K at position $X_8$ or $X_9$, or if $X_5$ is K its amine sidechain forms an amide bond with the sidechain of E at position $X_1$ or $X_2$; $X_6$ is r, [hArg], [NmeArg], R, K or E and if $X_6$ is E its carboxylate sidechain forms an amide bond with the sidechain of a K at position $X_9$ or $X_{10}$, or if $X_6$ is K its amine sidechain forms an amide bond with the sidechain of E at position $X_2$ or $X_3$; $X_7$ is [Cha], [NmeLeu], K or E and if $X_7$ is E its carboxylate sidechain forms an amide bond with the sidechain of a K at position $X_{10}$ or $X_{11}$, or if K is $X_7$ its amine sidechain forms an amide bond with the sidechain of E at position $X_3$ or $X_4$; $X_8$ is S, K or E and if $X_8$ is E its carboxylate sidechain forms an amide bond with the sidechain of a K at position $X_{10}$ or $X_{11}$, or if $X_8$ is K its amine sidechain forms an amide bond with the side-chain of E at position $X_4$ or $X_5$; $X_9$ is H, or K and if $X_9$ is E its amine sidechain forms an amide bond with the sidechain of E at position $X_5$ or $X_6$; $X_{10}$ is K and its amine sidechain can, but does not necessarily form an amide bond with the sidechain of E at position $X_6$ or $X_7$; $X_{11}$ is G, or K and if $X_{11}$ is K its amine sidechain forms an amide bond with the sidechain of E at position $X_7$ or $X_8$; $X_{12}$ is [Oic], or K and if $X_{12}$ is K its amine sidechain forms an amide bond with the sidechain of E at position $X_8$ or $X_9$; $X_{13}$ is [p-I-Phe], [Nle], or K and if $X_{13}$ is E its amine sidechain forms an amide bond with the sidechain of E at position $X_9$, and $X_{14}$ is [D-Bip], [D-4ClF] or [4-Cl-F].

Exemplary cyclic apelin polypeptides conjugated to a lipid moiety are shown in Table 10. E1xxK1 or E1xxxK1 (underlined) indicates the position of cyclization via the side chains of the E and K residues.

TABLE 10

Exemplary Cyclic Apelin Polypeptides

| SEQ ID NO: | SEQUENCE |
|---|---|
| 648 | {TDA}[AC4Abu][Aeea][Aeea]Q[hArg]Pr[Cha]E1HKK1[Oic][Nle]P[4-Cl—F]{COOH} |
| 649 | {TDA}[AC4Abu][Aeea][Aeea]q[hArg]Pr[Cha]E1HKK1[Oic][Nle]P[4-Cl—F]{COOH} |
| 650 | {TDA}[AC4Abu][Aeea][Aeea]QrPr[Cha]E1HKK1[Oic][Nle]P[4-Cl—F]{COOH} |
| 651 | [TDA}[AC4Abu][Aeea][Aeea]q[hArg]PE1[Cha]SK1KG[Oic][Nle]P[4-Cl—F]{COOH} |
| 652 | {TDA}[AC4Abu][Aeea][Aeea]QrPE1[Cha]SK1KG[Oic][Nle]P[4-Cl—F]{COOH} |
| 653 | {TDA}[AC4Abu][Aeea][Aeea]rQ[hArg]PE1[Cha]SK1KG[Oic][Nle]P[4-Cl—F]{COOH} |
| 654 | {TDA}[AC4Abu][Aeea][Aeea]E1[hArg]QKIPr[Cha]SHKG[Oic][Nle]P[4-Cl—F}{COOH} |
| 655 | {TDA}[AC4Abu][Aeea][Aeea]QE1Pr[Cha]K1HKG[Oic][Nle]P[4-Cl—F]{COOH} |
| 656 | {TDA}[AC4Abu][Aeea][Aeea]rQE1Pr[Cha]K1HKG[Oic][Nle]P[4-Cl—F]{COOH} |
| 657 | {TDA}[AC4Abu][Aeea][Aeea]E1Q[hArg]PK1[Cha]SHKG[Oic][Nle]P[4-Cl—F}{COOH} |
| 658 | {TDA}[AC4Abu][Aeea][Aeea]Eq[hArg]PKI[Cha]SHKG[Oic][Nle]P[4-Cl—F]{COOH} |

TABLE 10-continued

| Exemplary Cyclic Apelin Polypeptides | |
|---|---|
| SEQ ID NO: | SEQUENCE |
| 659 | {TDA}[AC4Abu][Aeea][Aeea]ElQrPKl[Cha]SHKG[Oic][Nle]P[4-Cl-F]{COOH} |
| 660 | {TDA}[AC4Abu][Aeea][Aeea]El[hArg]Q[hArg]Klr[Cha]SHKG[Oic][Nle]P[4-CI-F]{COOH} |
| 661 | {Acetyl-NH} r[hArg]Q[hArg]PEI [NMeLeu]SKlKG[Oic][p]-Phe]P[D-Bip]{COOH} |
| 662 | {Acetyl-NH} [hArg][hArg]q[hArg]PEl\|NMeLeu]SKlKG[Oic][pI-Phe]P[D-Bip]{COOH} |
| 663 | {Acetyl-NH} [hArg][hArg] QrPEI [NMeLeu]SKlKG[Oic][pI-Phe]P[D-Bip]{COOH} |
| 664 | {Acetyl-NH} r[hArg]Q[hArg]PEl[Cha]SKlKG[Oic][pI-Phe]P[D-Bip] {COOH} |
| 665 | {Acetyl-NH} [hArg]rQ[hArg]PEl[Cha]SKlKG[Oic][pI-Phe]P[D-Bip] {COOH} |
| 666 | {Acetyl-NH} [hArg][hArg]q[hArg]PEl[Cha]SKlKG[Oic][pI-Phe]P[D-Bip]{COOH} |
| 667 | {Acetyl-NH} [hArg][hArg]QrPEI[Cha]SKlKG[Oic][pI-Phe]P[D-Bip] {COOH} |

In some embodiments, a modified apelin polypeptide of the invention can be described by the following formula:

(SEQ ID NO: 769)

$$Z_1\ Z_2\ X_1\ X_2\ X_3\ X_4X_5\ X_6X_7\ X_8X_9\ X_{10}X_{11}X_{12}\ X_{13}\ X_{14}\ X_{15}\ X_{16}\ X_{17},$$

Wherein $Z_1$ is an acyl group; $Z_2$ comprises a conjugation linker or is absent; $X_1$ is O, K, [D-Orn], [k], [BLys], [D-BLys], [BhLys], or [D-BhLys] or is absent; $X_2$ is F, [BhPhe], [BPhe] or is absent; $X_3$ is R, [hArg], [r], [NMeArg], [NMehArg], [rhArg], [rArg], [BhArg] or is absent; $X_4$ is R, [hArg], [r], [NMeArg], [NMehArg], [rhArg], [rArg], [BhArg] or is absent; $X_5$ is Q, L, N, [q], [l], [PE], [BhGln], [BhAsn], [aMeLeu], [aMeGln], [Bleu] or [BhLeu]; $X_6$ is R, [hArg], [r], [NMeArg], [NMehArg], [rhArg], [rArg] or [BhArg]; $X_7$ is P, [Sar], [Aib], [BhPro], [aMePro], [Oic], [rPro], or [Pip]; $X_8$ is R, [hArg], [r], [NMeArg], [NMehArg], [rhArg], [rArg] or [BhArg]; $X_9$ is L, [Cha], [NMeCha], [rCha], [rLeu], [NMeLeu], [aMeLeu], [BLeu], or [BhLeu]; $X_{10}$ is S, [aMeSer], [BhSer], [rSer], [Sar] or [bAla]; $X_{11}$ is H, A, V, L, Y, [Deg], [Tle], [NMeVal] or [bAla]; $X_{12}$ is K, [NMeLys], [BhLys], [BLys] or [bAla]; $X_{13}$ is G, [Sar], [Aib] or [bAla]; $X_{14}$ is P, [Sar], [Aib], [BhPro], [aMePro], [Oic], [Idc], [rPro], or [Pip]; $X_{15}$ is M, L, V, I, [Met(O)], [Nle], [Nva] or [pI-Phe]; $X_{16}$ is P, [Sar], [Aib], [BhPro], [aMePro], [Oic], [Idc], [rPro], or [Pip]; and $X_{17}$ is F, [Tic], [D-Tic], [Tiq], [D-Tiq], [4-Cl-F], [pI-Phe], [D-4FF], [D-4ClF], [D-41F], [Idc], [Aic], [Oic], [D-Igl], [f], [D-1Nal], [D-2Nal], [1-Nal], [2-Nal] or [D-Bip] or is absent. In one particular embodiment, $X_{16}$ is F, [Tic], [D-Tic], [Tiq], [D-Tiq], [4-Cl-F], [pI-Phe], [D-4FF], [D-4ClF], [D-41F], [Idc], [Aic], [Oic], [D-Igl], [f], [D-1Nal], [D-2Nal], [1-Nal], [2-Nal] or [D-Bip] and $X_{17}$ is absent.

In certain embodiments, $Z_1$ is a $C_1$ to $C_{25}$ saturated or unsaturated fatty acyl group. For instance, $Z_1$ can be any fatty acyl group from Table 6, such as a fatty acyl group selected from Octanoyl (Oct) or Decanoyl (Dec) or Dodecanoyl (DDA), Tridecanoyl (TDA), Tetradecanoyl (Myristoyl), Pentadecanoyl (PDA), Hexadecanoyl (Palmitoyl), Heptadecanoyl (HDA), Octadecanoyl (Stearoyl), Octadecandioyl (ODDA). In some embodiments, $Z_1$ is acetyl. In other embodiments, $Z_1$ is a 5 kDa, 10 kDa, or 20 kDa PEG polymer or any other PEG polymer disclosed herein. In some embodiments, $Z_2$ is a conjugation linker comprising Aeea, γ-glutamate, or combinations thereof. In other embodiments, the $Z_2$ conjugation linker is absent.

The present invention also provides for the use of one or more of the modified apelin polypeptides or conjugates thereof disclosed herein for the treatment or prevention of a disease, disorder, or other medical condition, particularly cardiac disorders. In one embodiment, the present provides a method for treating a cardiovascular condition in a subject in need thereof comprising administering to the subject a pharmaceutical composition comprising a therapeutically effective amount of any modified apelin polypeptide or half-life extension conjugate thereof described herein. A "therapeutically effective amount" refers to the amount of a compound that, when administered to a subject for treating a disease, or at least one of the clinical symptoms of a disease or disorder, is sufficient to affect such treatment for the disease, disorder, or symptom. The "therapeutically effective amount" can vary depending on the specific polypeptide or peptide conjugate employed, the disease, disorder, and/or symptoms of the disease or disorder, severity of the disease, disorder, and/or symptoms of the disease or disorder, the age of the subject to be treated, and/or the weight of the subject to be treated. An appropriate amount in any given instance can be readily apparent to those skilled in the art.

As used herein, "treating" or "treatment" of any disease or disorder refers to arresting or ameliorating a disease, disorder, or at least one of the clinical symptoms of a disease or disorder, reducing the risk of acquiring a disease, disorder, or at least one of the clinical symptoms of a disease or disorder, reducing the development of a disease, disorder or at least one of the clinical symptoms of the disease or disorder, or reducing the risk of developing a disease or disorder or at least one of the clinical symptoms of a disease or disorder. "Treating" or "treatment" also refers to inhibiting the disease or disorder, either physically, (e.g., stabilization of a discernible symptom), physiologically, (e.g., stabilization of a physical parameter), or both, or inhibiting at least one physical parameter which may not be discernible to the subject. Further, "treating" or "treatment" refers to delaying the onset of the disease or disorder or at least symptoms thereof in a subject which may be exposed to or predisposed to a disease or disorder even though that subject does not yet experience or display symptoms of the disease or disorder.

The cardiovascular conditions that may be treated or ameliorated with the modified apelin polypeptides or peptide conjugates of the invention include, but are not limited to, disorders affecting contractility of the heart or any form of heart disease or disorders accompanied by heart dysfunction, such as cardiac hypertrophy, hypertension, heart failure, congestive heart failure, cardiogenic shock, septic shock, acute decompensatory failure, pulmonary hypertension, myocardial infarction, ischemia, ischemia reperfusion injury, or cardiomyopathy. In certain embodiments, the cardiovascular condition is heart failure. All forms of heart failure, including but not limited to, systolic failure, diastolic failure, right ventricular failure, chronic heart failure, acute heart failure, and decompensated congestive heart failure, may be treated or ameliorated according to the methods of the invention. The modified apelin polypeptides of the invention or conjugates thereof can be used to treat patients with reduced ejection fraction or preserved ejection fraction. In one embodiment, the heart failure to be treated according to the methods of the invention is chronic systolic heart failure. In another embodiment, the heart failure to be treated according to the methods of the invention is chronic diastolic heart failure. In yet another embodiment, the heart failure to be treated according to the methods of the invention is acute heart failure. In some embodiments, the cardiovascular condition to be treated according to the methods of the invention is hypertension.

In other embodiments, the present invention provides a method of improving cardiac contractility in a subject having a cardiovascular condition comprising administering to the subject a pharmaceutical composition comprising a therapeutically effective amount of any modified apelin polypeptide or half-life extension conjugate thereof described herein, wherein cardiac contractility is improved following administration. In certain embodiments, the subject has chronic or acute heart failure. In some embodiments, administration of the pharmaceutical composition increases dP/dt max or ejection fraction as compared to these parameters prior to administration of the composition or to these parameters in a subject not receiving the pharmaceutical composition. Administration of the pharmaceutical composition may also result in increased exercise capacity, increased cardiac ejection fraction, decreased left ventricular end diastolic pressure, decreased pulmonary capillary wedge pressure, increased cardiac output, increased cardiac index, lowered pulmonary artery pressures, decreased left ventricular end systolic and diastolic dimensions, decreased left and right ventricular wail stress, and decreased wall tension relative to these parameters prior to administration of the pharmaceutical composition or to these parameters in a subject not receiving the pharmaceutical composition.

In one embodiment, the present invention also provides a method for increasing ejection fraction in a subject having a cardiovascular condition comprising administering to the subject a pharmaceutical composition comprising a therapeutically effective amount of any modified apelin polypeptide or half-life extension conjugate thereof described herein, wherein ejection fraction is increased following administration. In certain embodiments, the subject has acute or chronic heart failure.

In some embodiments, the subject to be treated according to the methods of the invention has one or more risk factors for heart disease including, for example, long standing uncontrolled hypertension, uncorrected valvular disease, chronic angina, recent myocardial infarction, congestive heart failure, congenital predisposition to heart disease or pathological hypertrophy. Alternatively or in addition, the subject may have been diagnosed as having a genetic predisposition to, for example, cardiac hypertrophy, hypertension, or other cardiac disorder or may have a familial history of, for example, cardiac hypertrophy, hypertension, or other cardiac disorder.

Other embodiments of the invention concern the use of the modified apelin polypeptides or conjugates thereof described herein to treat cardiac symptoms resulting from pulmonary arterial hypertension, cancer, diabetes, obesity, metastatic diseases, and HIV. Other embodiments concern the use of the modified apelin polypeptides or conjugates thereof described herein for the treatment or prevention of various other disorders or diseases, such as, but not limited, to treatment of disorders associated with lipid and glucose metabolism, disorders associated with regulation and function of the GI tract, protection against HIV cell entry, and protection from cell apoptosis.

Pharmaceutical compositions comprising a modified apelin polypeptide or conjugate thereof can be configured for administration to a patient by a wide variety of delivery routes, e.g., an intravascular delivery route such as by injection or infusion, subcutaneous ("s.c."), intravenous ("i.v."), intramuscular, intraperitoneal ("i.p."), epidural, or intrathecal delivery routes, or for oral, enteral, pulmonary (e.g., inhalant), intranasal, transmucosal (e.g., sublingual administration), transdermal or other delivery routes and/or forms of administration known in the art. Delivery of a drug or pharmaceutical composition containing a modified apelin polypeptide or conjugate thereof, may take place via standard injectable modalities, whether self-administered using prefilled syringes or in hospital setting, or also via a delivery pump such as an autoinjector, a patch pump or large volume injector to achieve the most accurate dosing and the most stable plasma exposure levels.

Thus, the present invention also includes pharmaceutical compositions comprising any of the modified apelin polypeptides or conjugates thereof described herein and a pharmaceutically acceptable carrier. The pharmaceutical compositions may be prepared in liquid form, or may be in dried powder form, such as lyophilized form. For oral or enteral use, the pharmaceutical compositions can be configured, for example, as tablets, troches, lozenges, aqueous or oily suspensions, dispersible powders or granules, emulsions, hard or soft capsules, syrups, elixirs or enteral formulas.

In the practice, the "pharmaceutically acceptable carrier" can be any physiologically tolerated substance known to those of ordinary skill in the art useful in formulating pharmaceutical compositions, including, any pharmaceutically acceptable diluents, excipients, dispersants, binders, fillers, glidants, anti-frictional agents, compression aids, tablet-disintegrating agents (disintegrants), suspending agents, lubricants, flavorants, odorants, sweeteners, permeation or penetration enhancers, preservatives, surfactants, solubilizers, emulsifiers, thickeners, adjuvants, dyes, coatings, encapsulating material(s), and/or other additives singly or in combination. Such pharmaceutical compositions can include diluents of various buffer content (e.g., Tris-HCl, acetate, phosphate), pH and ionic strength; additives such as detergents and solubilizing agents (e.g., Tween® 80, Polysorbate 80), anti-oxidants (e.g., ascorbic acid, sodium metabisulfite), preservatives (e.g., Thimersol®, benzyl alcohol) and bulking substances (e.g., lactose, mannitol); incorporation of the material into particulate preparations of polymeric compounds such as polylactic acid, polyglycolic acid, etc. or into liposomes. Hyaluronic acid can also be used, and this can have the effect of promoting sustained duration in the circulation. Such compositions can influence the physical state, stability, rate of in vivo release, and rate of in vivo clearance of the present proteins and derivatives. See, e.g., Remington's Pharmaceutical Sciences, 18th ed., Mack Publishing Co., Easton, PA 18042, pp. 1435-1712, 1990, which are herein incorporated by reference in their entirety. The compositions can be prepared in liquid form, or can be in dried powder, such as lyophilized form. Implantable sustained release formulations are also useful, as are transdermal or transmucosal formulations. Additionally (or alternatively), various embodiments provide compositions for use in any of the various slow or sustained release formulations or microparticle formulations known to the skilled artisan, for example, sustained release microparticle formulations, which can be administered via pulmonary, intranasal, or subcutaneous delivery routes. (See, e.g., Murthy et al., "Injectable compositions for the controlled delivery of pharmacologically active compound", U.S. Pat. No. 6,887,487; Manning et al., "Solubilization of pharmaceutical substances in an organic solvent and preparation of pharmaceutical powders using the same", U.S. Pat. Nos. 5,770,559 and 5,981,474; Lieberman et al., "Lipophilic complexes of pharmacologically active inorganic mineral acid esters of organic compounds", U.S. Pat. No. 5,002,936; Gen, "Formative agent of protein complex", US 2002/0119946 A1; Goldenberg et al., "Sustained release formulations", WO 2005/105057 A1).

One can dilute the compositions or increase the volume of the pharmaceutical compositions with an inert material. Such diluents can include carbohydrates, especially, mannitol, α-lactose, anhydrous lactose, cellulose, sucrose, modified dextrans and starch. Certain inorganic salts may also be used as fillers, including calcium triphosphate, magnesium carbonate and sodium chloride.

A variety of conventional thickeners are useful in creams, ointments, suppository and gel configurations of the pharmaceutical composition, such as, but not limited to, alginate, xanthan gum, or petrolatum, may also be employed in various configurations of the pharmaceutical composition.

In various embodiments, liquid pharmaceutical compositions that are sterile solutions or suspensions can be administered to a patient by injection, for example, intramuscularly, intrathecally, epidurally, intravascularly (e.g., intravenously or intraarterially), intraperitoneally or subcutaneously. See, e.g., Goldenberg et al., "Suspensions for the sustained release of proteins", U.S. Pat. No. 6,245,740 and WO 00/38652 A1. Sterile solutions can also be administered by intravenous infusion. The composition can be included in a sterile solid pharmaceutical composition, such as a lyophilized powder, which can be dissolved or suspended at a convenient time before administration to a patient using sterile water, saline, buffered saline or other appropriate sterile injectable medium.

Implantable sustained release formulations are also useful embodiments of the pharmaceutical compositions. For example, the pharmaceutically acceptable carrier, being a biodegradable matrix implanted within the body or under the skin of a human or non-human vertebrate, can be a hydrogel similar to those described above. Alternatively, it may be formed from a poly-alpha-amino acid component. (Sidman, "Biodegradable, implantable drug delivery device, and process for preparing and using same", U.S. Pat. No. 4,351,337). Other techniques for making implants for delivery of drugs are also known and useful.

In powder forms, the pharmaceutically acceptable carrier is a finely divided solid, which is in admixture with finely divided active ingredient(s), including the composition. For example, in some embodiments, a powder form is useful when the pharmaceutical composition is configured as an inhalant. See, e.g., WO 2004/017918; U.S. Pat. No. 6,900,317).

One can dilute or increase the volume of the compound with an inert material. These diluents could include carbohydrates, especially mannitol, α-lactose, anhydrous lactose, cellulose, sucrose, modified dextrans and starch. Certain inorganic salts can also be used as fillers including calcium triphosphate, magnesium carbonate and sodium chloride. Some commercially available diluents are Fast-Flo™, Emdex™, STA-Rx™ 1500, Emcompress™ and Avicell™.

Binders can be used to hold the therapeutic agent together to form a hard tablet and include materials from natural products such as acacia, tragacanth, starch and gelatin. Others include methyl cellulose (MC), ethyl cellulose (EC) and carboxymethyl cellulose (CMC). Polyvinyl pyrrolidone (PVP) and hydroxypropylmethyl cellulose (HPMC) could both be used in alcoholic solutions to granulate the therapeutic. An antifrictional agent can be included in the formulation of the therapeutic to prevent sticking during the formulation process. Lubricants can be used as a layer between the therapeutic and the die wall, and these can include but are not limited to; stearic acid including its magnesium and calcium salts, polytetrafluoroethylene (PTFE), liquid paraffin, vegetable oils and waxes. Soluble lubricants can also be used such as sodium lauryl sulfate, magnesium lauryl sulfate, polyethylene glycol of various molecular weights, Carbowax 4000 and 6000.

Also useful in various embodiments are oral dosage forms. If necessary, the composition can be chemically modified so that oral delivery is efficacious. Generally, the chemical modification contemplated is the attachment of at least one moiety to the molecule itself, where said moiety permits (a) inhibition of proteolysis; and (b) uptake into the blood stream from the stomach or intestine. Also desired is the increase in overall stability of the compound and increase in circulation time in the body. Moieties useful as covalently attached half-life extending moieties can also be used for this purpose. Examples of such moieties include: PEG, copolymers of ethylene glycol and propylene glycol, carboxymethyl cellulose, dextran, polyvinyl alcohol, polyvinyl pyrrolidone and polyproline. See, for example, Abuchowski and Davis, "Soluble Polymer-Enzyme Adducts, Enzymes as Drugs", Hocenberg and Roberts, eds., Wiley-Interscience, New York, New York, pp. 367-383, 1981; Newmark et al., J. Appl. Biochem., 4:185-189, 1982. Other polymers that could be used are poly-1,3-dioxolane and poly-1,3,6-tioxocane. Preferred for pharmaceutical usage, as indicated above, are PEG moieties.

For oral delivery dosage forms, it is also possible to use a salt of a modified aliphatic amino acid, such as sodium N-(8-[2-hydroxybenzoyl] amino) caprylate (SNAC), as a carrier to enhance absorption of the therapeutic compounds. The clinical efficacy of a heparin formulation using SNAC has been demonstrated in a Phase II trial conducted by Emisphere Technologies. See U.S. Pat. No. 5,792,451, "Oral drug delivery composition and methods."

In one embodiment, the pharmaceutically acceptable carrier can be a liquid and the pharmaceutical composition is prepared in the form of a solution, suspension, emulsion, syrup, elixir or pressurized composition. The active ingredient(s) (e.g., the composition of matter) can be dissolved, diluted or suspended in a pharmaceutically acceptable liquid carrier such as water, an organic solvent, a mixture of both, or pharmaceutically acceptable oils or fats. The liquid carrier can contain other suitable pharmaceutical additives such as detergents and/or solubilizers (e.g., Tween 80, Polysorbate 80), emulsifiers, buffers at appropriate pH (e.g., Tris-HCl, acetate, phosphate), adjuvants, anti-oxidants (e.g., ascorbic acid, sodium metabisulfite), preservatives (e.g., Thimersol, benzyl alcohol), sweeteners, flavoring agents, suspending agents, thickening agents, bulking substances (e.g., lactose, mannitol), colors, viscosity regulators, stabilizers, electrolytes, osmolutes or osmo-regulators. Additives can also be included in the formulation to enhance uptake of the composition. Additives potentially having this property are for instance the fatty acids oleic acid, linoleic acid and linolenic acid.

Also useful are oral solid dosage forms, which are described generally in Remington's Pharmaceutical Sciences (1990), supra, in Chapter 89, which is hereby incorporated by reference in its entirety. Solid dosage forms include tablets, capsules, pills, troches or lozenges, cachets or pellets. Also, liposomal or proteinoid encapsulation can be used to formulate the present compositions (as, for example, proteinoid microspheres reported in U.S. Pat. No. 4,925,673). Liposomal encapsulation can be used and the liposomes can be derivatized with various polymers (e.g., U.S. Pat. No. 5,013,556). A description of possible solid dosage forms for the therapeutic is given in Marshall, K., Modern Pharmaceutics (1979), edited by G. S. Banker and C. T. Rhodes, in Chapter 10, which is hereby incorporated by reference in its entirety. In general, the formulation will include the compound, and inert ingredients that allow for protection against the stomach environment, and release of the biologically active material in the intestine.

In tablet form, the active ingredient(s) are mixed with a pharmaceutically acceptable carrier having the necessary compression properties in suitable proportions and compacted in the shape and size desired.

The powders and tablets can contain up to 99% of the active ingredient(s). Suitable solid carriers include, for example, calcium phosphate, magnesium stearate, talc, sugars, lactose, dextrin, starch, gelatin, cellulose, polyvinylpyrrolidine, low melting waxes and ion exchange resins.

Controlled release formulation can be desirable. In various embodiments the composition can be incorporated into an inert matrix that permits release by either diffusion or leaching mechanisms e.g., gums. Slowly degenerating matrices can also be incorporated into the formulation, e.g., alginates, polysaccharides. Another form of a controlled release of the compositions is by a method based on the Oros™ therapeutic system (Alza Corp.), i.e., the drug is enclosed in a semipermeable membrane which allows water to enter and push drug out through a single small opening due to osmotic effects. Some enteric coatings also have a delayed release effect.

Pulmonary delivery of the compositions may also be useful. The protein (or derivative) is delivered to the lungs of a mammal while inhaling and traverses across the lung epithelial lining to the blood stream. (Other reports of this include Adjei et al., Pharma. Res. (1990) 7: 565-9; Adjei et al. (1990), Intematl. J. Pharmaceutics 63: 135-44 (leuprolide acetate); Braquet et al. (1989), J. Cardiovasc. Pharmacol. 13 (suppl.5): s.143-146 (endothelin-1); Hubbard et al. (1989), Annals Int. Med. 3: 206-12 (al-antitrypsin); Smith et al. (1989), J. Clin. Invest. 84: 1145-6 (al-proteinase); Oswein et al. (March 1990), "Aerosolization of Proteins," Proc. Symp. Resp. Drug Delivery II, Keystone, Colorado (recombinant human growth hormone); Debs et al. (1988), J. Immunol. 140: 3482-8 (interferon-γ and tumor necrosis factor α) and Platz et al., U.S. Pat. No. 5,284,656 (granulocyte colony stimulating factor).

The dosage regimen involved in a method for treating a condition will be determined by the attending physician, considering various factors which modify the action of drugs, e.g. the age, condition, body weight, sex and diet of the patient, the severity of any infection, time of administration and other clinical factors. Generally, the daily regimen should be in the range of 0.1-1000 micrograms of the compound per kilogram of body weight, preferably 0.1-150 micrograms per kilogram.

By way of further illustration, the following numbered embodiments are presented: Embodiment 1

An isolated polypeptide comprising the following formula:

(SEQ ID NO: 721)

$X_1\ X_2\ X_3\ X_4$ wherein:

$X_1$ is a fatty acyl group, $X_2$ is γGlu or another suitable spacer moiety or is absent, $X_3$ is a PEG group or another suitable spacer moiety or is absent, and $X_4$ is an apelin polypeptide.

In various embodiments, the modified apelin polypeptide of Embodiment 1 does not have a half-life extension moiety (e.g PEG, lipid, immunoglobulin or immunoglobulin Fc), but will still have increased stability relative to native apelin polypeptides and can have at least 3, 4, 5, 6, 7 or 8 non-canonical amino acid substitutions.

Embodiment 2

The isolated polypeptide of embodiment 1 wherein $X_2$ is γGlu.

Embodiment 3

The isolated polypeptide of embodiment 1, wherein the fatty acyl group is a $C_1$ to $C_{25}$ fatty acyl group.

Embodiment 4

The isolated polypeptide of embodiment 3, wherein the fatty acyl group is Butanoyl, Hexanoyl, Octanoyl, Decanoyl, Dodecanoyl, Tridecanoyl, Tetradecanoyl, Pentadecanoyl, Hexadecanoyl, Heptadecanoyl, Octadecanoyl, Octadecandioyl, Octanedioyl, Decanedioyl, Dodecanedioyl, Hexanedioyl, Butanedioyl, Tetradecanedioyl, or Hexadecanedioyl.

Embodiment 5

The isolated polypeptide of any one of embodiments 1 to 4, wherein $X_3$ is Aeea, Aeea-Aeea, γGlu-Aeea, γGlu-Aeea-Aeea or γGlu.

Embodiment 6

The isolated polypeptide of embodiment 1, wherein $X_1$ is Octadecandioyl, Heptadecanoyl, Tridecanoyl, Butanoyl, Hexanoyl, Hexadecanoyl, Butanedioyl, Octanedioyl, or Decanedioyl; $X_2$ is γ-Glu or is absent; and $X_3$ is Aeea, Aeea-Aeea or is absent.

Embodiment 7

The isolated polypeptide of any one of embodiments 1 to 6, wherein the apelin polypeptide is at least 12 amino acids long.

Embodiment 8

The isolated polypeptide of any one of embodiments 1 to 7, wherein the apelin polypeptide has at least one non-canonical amino acid substitution.

Embodiment 9

The isolated polypeptide of embodiment 8, wherein the apelin polypeptide has 2, 3, 4, 5, 6, 7, 8 or 9 non-canonical amino acids.

Embodiment 10

The isolated polypeptide of embodiment 1, wherein the apelin polypeptide comprises at least one D-amino acid, a β-amino acid, a non-canonical amino acid, a N-methyl amino acid or an α-methyl amino acid, or the D- or β-form of the non-canonical amino acid.

Embodiment 11

The isolated polypeptide of embodiment 10, wherein the D-amino acid, the n-amino acid, the N-methyl amino acid, the α-methyl amino acid, the non-canonical amino acid or the D- or β-form of the non-canonical amino acid replaces a canonical amino acid in full-length apelin (SEQ ID NO: 2), apelin 42-77 (SEQ ID NO: 3), apelin 65-77 (apelin-13) (SEQ ID NO: 4), apelin 61-77 (SEQ ID NO: 5) or fragments of full-length apelin.

Embodiment 12

An isolated polypeptide comprising the amino acid sequence:

(SEQ ID NO: 719)
[z] $X_1$ $X_2$ $X_3X_4$ $X_5$ $X_6$ $X_7$SH$X_8$G[Oic] $X_9$ $X_{10}$ $X_{11}$, z is acetyl or absent, $X_1$ is acetyl, [r] or [hArg], $X_2$ is [r], R or [hArg], $X_3$ is Q or [q], $X_4$ is [hArg], R or [r]

$X_5$ is P or [Oic], $X_6$ is [r], [hArg] or [NMeArg], $X_7$ is [NMeLeu] or[Cha], $X_8$ is K or [NLysG], $X_9$ is [pl-Phe] or [Nle]

$X_{10}$ is P or [D-1Nal] or [Pip], and $X_{11}$ is a D-amino acid, a β-amino acid, a non-canonical amino acid or the D- or β-form of the non-canonical amino acid.

Embodiment 13

The isolated polypeptide of embodiment 12, wherein $X_{11}$ is [D-Bip], [4-CL-F], [D-4CLF], [TIC], [f] or is absent.

Embodiment 14

The isolated polypeptide of embodiment 12 having an amino acid sequence selected from the group of sequences consisting of SEQ ID NOs: 16-44.

Embodiment 15

An isolated polypeptide comprising the amino acid sequence:

{HDA}[AC4Abu][Aeea][Aeea] $X_1$ $X_2$ $X_3$P[Cha]SHKG [Oic][Nle] $X_4$ $X_5$ (SEQ ID NO: 722), wherein:

$X_1$ is [hArg] or is absent, $X_2$ is Q or [q], $X_3$ is [hArg] or [r], $X_4$ is P or [Pip] and $X_5$ is [4-Cl-F] or [D-4ClF]

Embodiment 16

The isolated polypeptide of embodiment 15 having an amino acid sequence selected from the group of sequences consisting of SEQ ID NOs: 237, 239, or 242.

Embodiment 17

An isolated polypeptide comprising the amino acid sequence:

(SEQ ID NO: 720)
[z]$X_1X_2$[hArg][hArg]$X_3X_4X_5X_6X_7X_8X_9X_{10}$G[Oic][Nle]$X_{11}$[4-Cl-F], wherein:

z is acetyl, $X_1$ is o or O, $X_2$ is f or F, $X_3$ is Q or [BLeu], $X_4$ is [hArg] or [rhArg], $X_5$ is P or [aMePro], $X_6$ is [hArg] or [rhArg], $X_7$ is [aMeLeu], [rCha], [BLeu] or [Cha], $X_8$ is [NhSerG], [aMeS], [rSer],[DrSer], or S, $X_9$ is H or [rHis]

$X_{10}$ is K, [NLysG], [rLys], or [aMeOrn], and $X_{11}$ is P or [aMePro].

Embodiment 18

The isolated polypeptide of embodiment 17 having an amino acid sequence selected from the group of sequences consisting of SEQ ID NOs: 29-44.

Embodiment 19

An isolated polypeptide comprising the amino acid sequence:

{TDA}[AC4Abu][Aeea][Aeea] $X_1$ $X_2$ $X_3$ $X_4$ $X_5X_6$ $X_7$ $X_8$KG[Oic] $X_9$ $X_{10}$ $X_{11}$ (SEQ ID No.724), wherein:

$X_1$ is [hArg], [r] or is absent, $X_2$ is Q, [q], [BLeu] or [NMeGln], $X_3$ is [hArg] or [r], $X_4$ is P, [Pip], [Oic] or [Sar], $X_5$ is [NMeArg],[r] or [hArg], $X_6$ is [Cha], [NMeLeu], [BLeu] or [NMeCha], $X_7$ is S, [BhSer], [bAla], [NhSerG] or [aMeS], $X_8$ is H, A, Y, [Tle], [Deg], L or V, $X_9$ is [Nle] or [pl-Phe], $X_{10}$ is P, a D-amino acid, a β-amino acid, a non-canonical amino acid or the D- or β-form of the non-canonical amino acid, and $X_{11}$ is [4-Cl-F], [D-4ClF], [D-Bip] or is absent.

Embodiment 20

The isolated polypeptide of embodiment 19, wherein:

$X_{10}$ is [D-Tic], [4-Cl-F], [D-4ClF], [Aic], [Oic], [D-4F], [D-Ogl], [f], [1-Nal], [2-Nal], [D-Bip], [Tic], [Aib] or [Deg].

Embodiment 21

The isolated polypeptide of embodiment 19 having an amino acid sequence selected from the group of sequences consisting of SEQ ID NOs: 121-210 and 245-256.

Embodiment 22

The isolated polypeptide of embodiment 19, wherein TDA is replaced with HDA.

Embodiment 23

An isolated polypeptide comprising the amino acid sequence:

{TDA}[AC4Abu][Aeea][Aeea] $X_1$q[hArg]P[NMeArg][Cha]SHKG[Oic][Nle]$X_2X_3$ (SEQ ID No. 725) wherein:

$X_1$ is [hArg] or is absent, $X_2$ is P, a D-amino acid or a non-canonical amino acid, and $X_3$ is a D-amino acid, a non-canonical amino acid or —COOH.

Embodiment 24

The isolated polypeptide of embodiment 23 having an amino acid sequence selected from the group of sequences consisting of SEQ ID NOs: 121-152.

Embodiment 25

An isolated polypeptide comprising the amino acid sequence {TDA}[AC4Abu][Aeea][Aeea][hArg]q[hArg]P[NMeArg][Cha]SHKG[Oic][Nle] $X_1$COOH (SEQ ID NO: 726), wherein $X_1$ is a D-amino acid, a R-amino acid, a non-canonical amino acid or the D- or β-form of the non-canonical amino acid.

Embodiment 26

The isolated polypeptide of embodiment 25, wherein $X_1$ is [D-Tic], [4-CL-F], [D-4ClF], [Aic], [Oic], [D-41F], [D-IgL], [f], [1-Nal], [2-Nal], [D-Bip] or [Tic].

Embodiment 27

The isolated polypeptide of embodiment 25 having an amino acid sequence selected from the group of sequences consisting of SEQ ID NOs: 166, 171, and 245-256.

Embodiment 28

An isolated polypeptide comprising the amino acid sequence {TDA}[AC4Abu][Aeea][Aeea]Q$X_1$P$X_2X_3$SHKG[Oic]$X_4X_5X_6$ (SEQ ID No. 727), wherein:

$X_1$ is R, r or [hArg], $X_2$ is r, [hArg] or [NMeArg], $X_3$ is [NMeLeu] or [Cha], $X_4$ is [pl-Phe] or [Nle], $X_5$ is P or [D-1Nal], and $X_6$ is [D-Bip], [4-CL-F], [D-4ClF] or is absent.

Embodiment 29

The isolated polypeptide of embodiment 28 having an amino acid sequence selected from the group of sequences consisting of SEQ ID NOs: 165 and 211-233.

Embodiment 30

An isolated polypeptide comprising the amino acid sequence (SEQ ID NO. 723)

{HDA}[AC$_4$Abu][Aeea]|Aeea]$X_1X_2X_3$

P$X_4X_5$SHKG[Oic]|Nle]$X_6X_7$ wherein:

$X_1$ is [hArg] or is absent, $X_2$ is Q or [q], $X_3$ is r or [hArg], $X_4$ is r or [NMeArg], $X_5$ is [NMeLeu] or [Cha], $X_6$ is [Pip] or P, and $X_7$ is [4-CL-F], [f], [D-4ClF], or [Tic].

Embodiment 31

The isolated polypeptide of embodiment 30, wherein HDA is replaced by TDA or other fatty acyl group.

Embodiment 32

The isolated polypeptide of embodiment 30 having an amino acid sequence selected from the group of sequences consisting of SEQ ID NOs: 234-243.

Embodiment 33

An isolated polypeptide comprising the amino acid sequence (SEQ ID NO. 728)
{TDA}[AC4Abu][Aeea][Acea]$X_1X_2X_3PX_4$ $X_5X_6X_7$KG[Oic]$X_8X_9X_{10}$ wherein:

$X_1$ is [hArg] or [r], $X_2$ is Q or [q], $X_3$ is r or [hArg], $X_4$ is r or [NMeArg], $X_5$ is [NMeLeu] [BLeu] or [Cha], $X_6$ is S or [bAla], $X_7$ is H, A or [Tle], $X_8$ is [Nle] or [pl-Phe], $X_9$ is P, a D-amino acid, a R-amino acid, a non-canonical amino acid or the D- or β-form of the non-canonical amino acid, and $X_{10}$ is [Oic], [D-4ClF], [D-1Nal], [D-Bip] or is absent.

Embodiment 34

The isolated polypeptide of embodiment 33, wherein $X_9$ is [D-Tic], [4-Cl-F], [D-4ClF], [Aic], [Oic], [D-igl], [f], [D-1Nal], [D-2Nal], [1-Nal], [2-Nal] or [D-Bip] and $X_{10}$ is absent.

Embodiment 35

The isolated polypeptide of embodiment 33, wherein TDA is replaced by HDA.

Embodiment 36

The isolated polypeptide of embodiment 33 having an amino acid sequence selected from the group of sequences consisting of SEQ ID NOs: 153-155, 166, 171, 173-175, 180, 199, 201, 208, and 245-256.

Embodiment 37

An isolated polypeptide comprising the amino acid sequence:

(SEQ ID NO. 45)
AcOF[hArg][hArg]Q[hArg]P[hArg][Cha]

SHKG[Oic][Nle]P[4-Cl-F].

Embodiment 38

An isolated polypeptide having an amino acid sequence selected from the group of any one of SEQ ID NOs: 7-714.

Embodiment 39

The isolated polypeptide of any one of embodiments 1 to 38, wherein the polypeptide has increased stability relative to wild-type apelin 13 (SEQ ID NO: 4).

Embodiment 40

An isolated polypeptide comprising the formula:

$N_1$[AC4Abu]$N_2$X wherein:

$N_1$ is a fatty acyl group or Acetyl-NH, $N_2$ is [Aeea][Aeea] or [Aeea], and

X is an apelin polypeptide of 11, 12, 13, 14, 15, 16 or 17 amino acids long comprising E1xxK1 (cyclized via an amide bond between E and K) wherein xx can be 2-3 amino acids selected from D- or L-amino acids, α- or β-amino acids, homologated amino acids, N-methylated amino acids, α-methyl amino acids, amino acids bearing the side chain on N instead of the α-carbon or another canonical or non-canonical amino acid.

Embodiment 41

An isolated polypeptide comprising the amino acid sequence:

$AcX_1\ X_2\ X_3\ X_4X_5\ X_6X_7\ X_8X_9\ X_{10}X_{11}X_{12}\ X_{13}\ X_{14}\ X_{15}\ X_{16}\ X_{17}$ (SEQ ID NO: 718), wherein:

$X_1$ is O or [BhLys], $X_2$ is F, [BhPhe] or [Bphe], $X_3$ is [hArg], [NMeArg] or [BhArg], $X_4$ is [hArg], [NMeArg] or [BhArg], $X_5$ is Q, [BhGln], [BhAsn] or [BhLeu], $X_6$ is [hArg], [NMeArg] or [BhArg], $X_7$ is P, [Sar], [Aib], [BhPro] or [Pip], $X_8$ is [hArg], [NMeArg] or [BhArg], $X_9$ is [Cha] or [BhLeu], $X_{10}$ is S, [BhSer], [Sar] or [bAla], $X_{11}$ is H, [NMeVal] or [bAla], $X_{12}$ is K, [NMeLys], [BhLys], [BLys] or [bAla], $X_{13}$ is G, [Sar], [Aib] or [bAla], $X_{14}$ is [Oic], [Aib], [Sar], [bAla], [BhPro] or [Pip], $X_{15}$ is [Nle] or [bAla], $X_{16}$ is P, [Sar], [Aib], [BhPro], [bAla], [Pip], [D-1Nal] or [D-2Nal] and $X_{17}$ is [4-Cl-F], [Bh-Phe] or [BPhe].

Embodiment 42

The isolated polypeptide of embodiment 41 having an amino acid sequence selected from the group of sequences consisting of SEQ ID NOs: 668-714.

Embodiment 43

An isolated polypeptide comprising the amino acid sequence:

(SEQ ID NO: 768)
$[Z]X_1X_2X_3X_4X_5X_6X_7X_8X_9X_{10}X_{11}X_{12}X_{13}PX_{14}$ having only one amide bond between the carboxylate side chain of E and the amino side chain of K and wherein:

Z is acetyl, acyl, [Atz(PEG10)], a PEG derivative, {TDA}[AC4Abu][Aeea][Aeea], or other half-life extension moiety or is absent, $X_1$ is r, [hArg], [NMeArg], R, absent, or E and if $X_1$ is E its carboxylate sidechain forms an amide bond with the sidechain of a K at position $X_4$ or $X_5$, $X_2$ is r, [hArg], [NMeArg], R, absent, or E and if $X_2$ is E its carboxylate sidechain forms an amide bond with the sidechain of a K at position $X_5$ or $X_6$, $X_3$ is Q, q, or E and if $X_3$ is E its carboxylate sidechain forms an amide bond with the sidechain of a K at position $X_6$ or $X_7$, $X_4$ is r, [hArg], [NMeArg], R, K or E and if $X_4$ is E its carboxylate sidechain forms an amide bond with the sidechain of a K at position $X_7$ or $X_8$, or if $X_4$ is K its amine sidechain forms an amide bond with the sidechain of E at position $X_1$, $X_5$ is P, K or E and if $X_5$ is E its carboxylate sidechain forms an amide bond with the sidechain of a K at position $X_8$ or $X_9$, or if $X_5$ is K its amine sidechain forms an amide bond with the sidechain of E at position $X_1$ or $X_2$, $X_6$ is r, [hArg], [NMeArg], R, K or E and if $X_6$ is E its carboxylate sidechain forms an amide bond with the sidechain of a K at position $X_9$ or $X_{10}$, or if $X_6$ is K its amine sidechain forms an amide bond with the sidechain of E at position $X_2$ or $X_3$, $X_7$ is [Cha], [NMeLeu], K or E and if $X_7$ is E its carboxylate sidechain forms an amide bond with the sidechain of a K at position $X_{10}$ or $X_{11}$, or if K is $X_7$ its amine sidechain forms an amide bond with the sidechain of E at position $X_3$ or $X_4$, $X_8$ is S, K or E and if $X_8$ is E its carboxylate sidechain forms an amide bond with the sidechain of a K at position $X_{10}$ or $X_{11}$, or if $X_8$ is K its amine sidechain forms an amide bond with the sidechain of E at position $X_4$ or $X_5$, $X_9$ is H, or K and if $X_9$ is E its amine sidechain forms an amide bond with the sidechain of E at position $X_5$ or $X_6$, $X_{10}$ is K and its amine sidechain can, but does not necessarily form an amide bond with the sidechain of E at position $X_6$ or $X_7$, $X_{11}$ is G, or K and if $X_1$ is K its amine sidechain forms an amide bond with the sidechain of E at position $X_7$ or $X_8$, $X_{12}$ is [Oic], or K and if $X_{12}$ is K its amine sidechain forms an amide bond with the sidechain of E at position $X_8$ or $X_9$, $X_{13}$ is [p-I-Phe], [Nle], or K and if $X_{13}$ is E its amine sidechain forms an amide bond with the sidechain of E at position $X_9$, and $X_{15}$ is [D-Bip], [D-4ClF] or [4-Cl-F].

Embodiment 44

An isolated polypeptide comprising the amino acid sequence:

$Z_1\,Z_2\,X_1\,X_2\,X_3\,X_4X_5\,X_6X_7\,X_8X_9\,X_{10}X_{11}X_{12}\,X_{13}\,X_{14}\,X_{15}\,X_{16}\,X_{17}$ (SEQ ID NO: 769), wherein $Z_1$ is an acyl group $Z_2$ comprises a conjugation linker or is absent, $X_1$ is O, K, [D-Orn], [k], [BLys], [D-BLys], [BhLys], or [D-BhLys] or is absent, $X_2$ is F, [BhPhe], [BPhe] or is absent, $X_3$ is R, [hArg], [r], [NMeArg], [NMehArg], [rhArg], [rArg], [BhArg] or is absent, $X_4$ is R, [hArg], [r], [NMeArg], [NMehArg], [rhArg], [rArg], [BhArg] or is absent, $X_5$ is Q, L, N, [q], [l], [PE], [BhGln], [BhAsn], [aMeLeu], [aMeGln], [Bleu] or [BhLeu], $X_6$ is R, [hArg], [r], [NMeArg], [NMehArg], [rhArg], [rArg] or [BhArg], $X_7$ is P, [Sar], [Aib], [BhPro], [aMePro], [Oic], [rPro], or [Pip], $X_8$ is R, [hArg], [r], [NMeArg], [NMehArg], [rhArg], [rArg] or [BhArg], $X_9$ is L, [Cha], [NMeCha], [rCha], [rLeu], [NMeLeu], [aMeLeu], [BLeu], or [BhLeu], $X_{10}$ is S, [aMeSer], [BhSer], [rSer], [Sar] or [bAla], $X_{11}$ is H, A, V, L, Y, [Deg], [Tle], [NMeVal] or [bAla], $X_{12}$ is K, [NMeLys], [BhLys], [BLys] or [bAla], $X_{13}$ is G, [Sar], [Aib] or [bAla], $X_{14}$ is P, [Sar], [Aib], [BhPro], [aMePro], [Oic], [Idc], [rPro], or [Pip], $X_{15}$ is M, L, V, I, [Met(O)], [Nle], [Nva] or [pI-Phe], $X_{16}$ is P, [Sar], [Aib], [BhPro], [aMePro], [Oic], [Idc], [rPro], or [Pip], and $X_{17}$ is F, [Tic], [D-Tic], [Tiq], [D-Tiq], [4-Cl-F], [pI-Phe], [D-4FF], [D-4ClF], [D-41F], [Idc], [Aic], [Oic], [D-Igl], [f], [D-1Nal], [D-2Nal], [1-Nal], [2-Nal] or [D-Bip] or is absent.

Embodiment 45

The isolated polypeptide of embodiment 44, wherein $Z_1$ is a $C_1$ to $C_{25}$ saturated or unsaturated fatty acyl group.

Embodiment 46

The isolated polypeptide of embodiment 44, wherein $Z_1$ is Acetyl, Octanoyl (Oct), Decanoyl (Dec), Dodecanoyl (DDA), Tridecanoyl (TDA), Tetradecanoyl (Myristoyl), Pentadecanoyl (PDA), Hexadecanoyl (Palmitoyl), Heptadecanoyl (HDA), Octadecanoyl (Stearoyl), Octadecandioyl (ODDA) or any fatty acyl or lipophilic group incorporated to extend the half-life of the polypeptide.

Embodiment 47

The isolated polypeptide of embodiment 44, wherein $Z_1$ is {5 kDa},{10 kDa},{20 kDa} or any other polyethylene glycol (PEG) polymer that is incorporated to extend the half-life of the polypeptide.

Embodiment 48

The isolated polypeptide of embodiment 44, wherein Aeea, γ-glutamate, or any other moiety is present as a constituent of the $Z_2$ conjugation linker.

Embodiment 49

The isolated polypeptide of embodiment 48, wherein the conjugation linker may be a polar, non-polar, hydrophobic, aliphatic, or aromatic moiety that serves a special, functional or structural role.

Embodiment 50

The isolated polypeptide of embodiment 44, wherein the $Z_2$ conjugation linker is absent.

Embodiment 51

The isolated polypeptide of embodiment 44, wherein $X_{16}$ is F, [Tic], [D-Tic], [Tiq], [D-Tiq], [4-Cl-F], [pI-Phe], [D-4FF], [D-4ClF], [D-41F], [Idc], [Aic], [Oic], [D-Igl], [f], [D-1Nal], [D-2Nal], [1-Nal], [2-Nal] or [D-Bip] and $X_{17}$ is absent.

Embodiment 52

An isolated polypeptide comprising the amino acid sequence:

$X_1$ $X_2$ $X_3X_4$ $X_5$ $X_6$ $X_7$ $X_8$ $X_9X_{10}GX_{11}X_{12}$ $X_{13}$ $X_{14}$ (SEQ ID NO: 717), wherein:

$X_1$ is R, E, [hArg], or absent;
$X_2$ is [r], R, E, [hArg], or absent;
$X_3$ is Q, [q], or [BLeu];
$X_4$ is [hArg], [NMeArg], R, E, or [r];
$X_5$ is P or [aMePro];
$X_6$ is R, E, [r], [hArg] or [NMeArg];
$X_7$ is L, [aMeLeu], [BLeu], [NMeLeu] or [Cha];
$X_8$ is S, [BhSer], or [NhSerG];
$X_9$ is H or Y;
$X_{10}$ is K or [NLysG];
$X_{11}$ is P, [Oic], [aMePro], or [Pip];
$X_{12}$ is [Nle], [rNle], or [pI-Phe];
$X_{13}$ is P, [BhPro], [aMePro], or [Aib]; and
$X_{14}$ is F, [D-BhPhe], [4-Cl-F], [D-4ClF], or [D-Bip].

Embodiment 53

The isolated polypeptide of embodiment 52, wherein the polypeptide is acetylated at its amino terminus.

Embodiment 54

The isolated polypeptide of embodiment 52, wherein the polypeptide is conjugated to a $C_1$ to $C_{25}$ saturated or unsaturated fatty acyl group optionally through a conjugation linker.

Embodiment 55

The isolated polypeptide of embodiment 54, wherein the fatty acyl group is Tridecanoyl, Butanoyl, Hexanoyl, Hexadecanoyl, Butanedioyl, Octanedioyl, or Decanedioyl.

Embodiment 56

The isolated polypeptide of embodiment 54, wherein the fatty acyl group is Octanoyl, Decanoyl, Dodecanoyl, Tridecanoyl, Tetradecanoyl, Pentadecanoyl, Hexadecanoyl, Heptadecanoyl, Octadecanoyl, or Octadecandioyl.

Embodiment 57

The isolated polypeptide of embodiment 54, wherein the conjugation linker comprises Aeea, Aeea-Aeea, γGlu-Aeea, γGlu-Aeea-Aeea, or γGlu.

Embodiment 58

The isolated polypeptide of embodiment 52, wherein the polypeptide is conjugated to a polyethylene glycol (PEG) polymer optionally through a conjugation linker.

Embodiment 59

The isolated polypeptide of embodiment 58, wherein the PEG polymer is a 5 kDa, 10 kDa, or 20 kDa PEG polymer.

Embodiment 60

The isolated polypeptide of embodiment 58, wherein the conjugation linker comprises 3-mercaptopropanoic acid.

Embodiment 61

The isolated polypeptide of embodiment 52, wherein the polypeptide is conjugated to an immunoglobulin or an immunoglobulin Fc domain optionally through a conjugation linker.

Embodiment 62

The isolated polypeptide of embodiment 61, wherein the conjugation linker is a peptidyl linker.

Embodiment 63

The isolated polypeptide of embodiment 61, wherein the conjugation linker is a non-peptidyl linker.

Embodiment 64

The isolated polypeptide of embodiment 63, wherein the non-peptidyl linker comprises a PEG polymer.

Embodiment 65

The isolated polypeptide of embodiment 52, wherein $X_7$ is [NMeLeu], $X_{12}$ is [pI-Phe], and $X_{14}$ is [D-Bip].

Embodiment 66

The isolated polypeptide of embodiment 52, wherein $X_1$ is [hArg], $X_2$ is [hArg], $X_3$ is Q, $X_4$ is [hArg], and $X_5$ is P.

Embodiment 67

The isolated polypeptide of embodiment 52, wherein $X_6$ and $X_7$ are [NMeArg] and [aMeLeu], [hArg] and [BLeu], or [hArg] and [aMeLeu].

Embodiment 68

The isolated polypeptide of embodiment 52, wherein $X_{13}$ is [BhPro], [aMePro], or [Aib] and $X_{14}$ is [D-BhPhe] or [4-Cl-F].

Embodiment 69

The isolated polypeptide of embodiment 52, wherein the polypeptide comprises the amino acid sequence selected from SEQ ID NOs: 8-11, 16, 17, 31, 32, 45, 53, 60, 68, 69-71, 92, 112, 114, 119, 120, 221, 228, 237, 263, 286, 287, 362, 373, 376, 379, 382, 388, 412, 416, 460, 468, 482, 483, 485, 491, 498, 499, 500, 502, 505, 514, 519, 526, 531, 534, 544, 552, 554, 560, and 571.

Embodiment 70

A pharmaceutical composition comprising the polypeptide of any one of embodiments 1 to 69 and a pharmaceutically acceptable carrier.

Embodiment 71

A method for treating a cardiovascular condition in a subject in need thereof comprising administering to the subject an isolated polypeptide of any one of embodiments 1 to 69.

Embodiment 72

The method of embodiment 71, wherein the cardiovascular condition is heart failure.

Embodiment 73

The method of embodiment 72, wherein the heart failure is heart failure with reduced ejection fraction.

Embodiment 74

The method of embodiment 72, wherein the heart failure is heart failure with preserved ejection fraction.

Embodiment 75

The method of embodiment 72, wherein the heart failure is chronic systolic heart failure or chronic diastolic heart failure.

Embodiment 76

The method of embodiment 72, wherein the heart failure is acute heart failure.

Embodiment 77

The method of embodiment 71, wherein the cardiovascular condition is hypertension.

Embodiment 78

A method of improving cardiac contractility in a subject having a cardiovascular condition comprising administering to the subject the polypeptide of any one of embodiments 1 to 69, wherein cardiac contractility is improved in the subject following administration.

Embodiment 79

The method of embodiment 78, wherein the cardiovascular condition is heart failure.

Embodiment 80

The method of embodiment 79, wherein the heart failure is chronic systolic heart failure or chronic diastolic heart failure.

Embodiment 81

The method of any one of embodiments 71 to 80, wherein dP/dt max and/or ejection fraction is increased in the subject following administration of the polypeptide.

Embodiment 82

The method of any one of embodiments 71 to 80, wherein the systolic or diastolic function is improved in the subject following administration of the polypeptide.

Embodiment 83

A method of increasing ejection fraction in a subject having a cardiovascular condition comprising administering to the subject the polypeptide of any one of embodiments 1 to 69, wherein the ejection fraction is increased following administration of the polypeptide.

Embodiment 84

The method of embodiment 83, wherein the cardiovascular condition is heart failure.

Embodiment 85

The method of embodiment 84, wherein the heart failure is chronic systolic heart failure or chronic diastolic heart failure.

Embodiment 86

A method of improving systolic or diastolic function in a subject having a cardiovascular condition comprising administering to the subject the polypeptide of any one of embodiments 1 to 69.

Embodiment 87

The method of embodiment 86, wherein the cardiovascular condition is heart failure.

Embodiment 88

The method of embodiment 87, wherein the heart failure is chronic systolic heart failure or chronic diastolic heart failure.

Embodiment 89

A method of treating cardiac failure in a patient in need thereof comprising administering to the patient the polypeptide of any one of embodiments 1 to 69.

Embodiment 90

The method of embodiment 89, wherein the cardiac failure is cardiac failure with reduced ejection fraction.

Embodiment 91

The method of embodiment 89, wherein the cardiac failure is cardiac failure with preserved ejection fraction.

Embodiment 92

The method of embodiment 89, wherein the cardiac failure is chronic systolic cardiac failure or chronic diastolic cardiac failure.

The previous description and the following working examples are illustrative and not to be construed in any way as limiting the scope of the invention.

EXAMPLES

Example 1. Preparation of Modified Apelin Polypeptides

Polypeptides have been prepared that can act as APJ agonists. The polypeptides were screened for potency and metabolic stability as described in detail in the following examples. The sequences were optimized through techniques known in the art in which one or more amino acids may be changed while maintaining or improving the affinity, functional activity, or stability of the peptide. Nishizawa et al., Peptide Science 37:151-157, 2001; Murza et al., Chem MeD Chem., 7:318-325, 2012.

Various non-canonical amino acids were used in the preparation of the modified apelin polypeptides. Some of these amino acids are available commercially. The following describes methods for making certain non-canonical amino acids that can be used in the synthesis of modified apelin polypeptides.

SCHEME 1

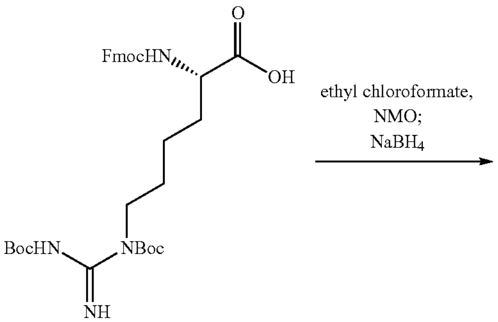

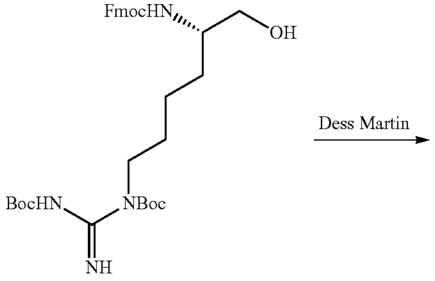

1

-continued

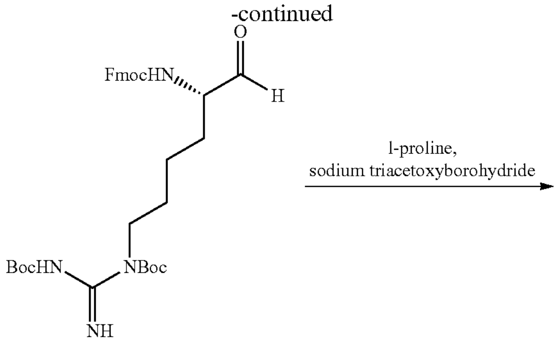

2

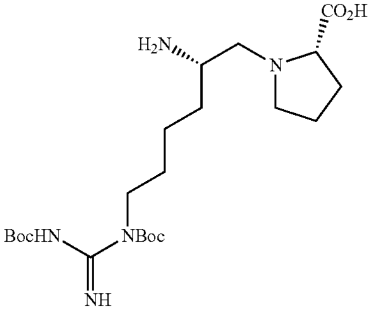

3

Preparation of Compound 1

4-Methylmorpholine (1.25 mL, 11.4 mmol) and ethyl chloroformate (1.09 mL, 11.4 mmol) were added to a stirred solution of (S)-2-((((9H-fluoren-9-yl)methoxy)carbonyl) amino)-6-(1,3-bis(tert-butoxycarbonyl)guanidino)hexanoic acid (6.95 g, 11.4 mmol) in THF (50 mL) at −10° C. in a 3-neck flask equipped with a thermometer. The mixture was stirred at −10° C. for 10 min. Sodium borohydride (1.29 g, 34.1 mmol) was added, and the reaction mixture was warmed to 0° C. Methanol (50 mL) was then added slowly at 0° C. over 30 min via addition funnel. The reaction mixture was then diluted with ethyl acetate and washed with 5% aqueous citric acid. The aqueous layer was separated and extracted once more with ethyl acetate. The combined organic layers were washed with 5% aqueous citric acid, saturated aqueous sodium bicarbonate, saturated aqueous sodium chloride, dried over anhydrous magnesium sulfate, filtered, and concentrated in vacuo to give an oil. The oil was purified by silica gel chromatography (50 to 100% EtOAc/heptane gradient) to give 1 (4.68 g, 69% yield) as a white solid. LC/MS ($ESI^-$) m/z=597.3 $(M+H)^+$.

Preparation of Compound 2

Dess-martin periodinane (5.19 g, 12.2 mmol) was added to an ice cold solution of 1 (5.62 g, 9.42 mmol) in DCM (50 mL) under argon. The ice bath was removed and the mixture was stirred for 3 h. The mixture was poured into a mixture of diethyl ether (100 mL) and saturated aqueous sodium bicarbonate (100 mL), and then it was stirred vigorously for 30 min. The resulting suspension was filtered and the filter cake was washed with diethyl ether. The biphasic filtrate was separated and the aqueous layer was extracted with diethyl ether (2×). The combined extracts were dried over anhydrous magnesium sulfate, filtered, and concentrated in vacuo to give 2, which was used without further purification.

Preparation of Compound 3

1-(−)-Proline (2.71 g, 23.6 mmol) and sodium triacetoxyborohydride (2.99 g, 14.1 mmol) were added to a 0° C. solution of 2 in DCM (50 mL) and the mixture was stirred overnight with warming to RT. Saturated aqueous sodium bicarbonate was added and the mixture was stirred until the biphasic mixture became clear. The layers were separated and the aqueous layer was extracted with 9:1 DCM/MeOH (2×). The combined extracts were dried over anhydrous magnesium sulfate, filtered, and concentrated in vacuo to give on oil. The oil was purified by silica gel chromatography (DCM to 9% MeOH/1% AcOH in DCM gradient) to give (S)-1-((S)-2-((((9H-fluoren-9-yl)methoxy)carbonyl)amino)-6-(1,3-bis(tert-butoxycarbonyl)guanidino)hexyl)pyrrolidine-2-carboxylic acid (3, 2.14 g, 33% yield from 1) as a white solid. LC/MS (ESI$^-$) m/z=694.4 (M+H)$^+$.

SCHEME 2

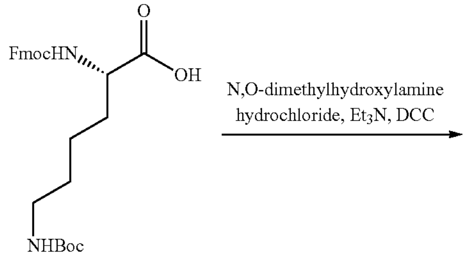

4

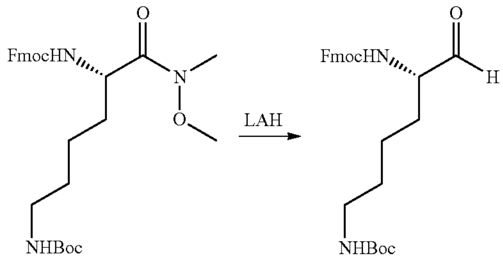

5

6

+

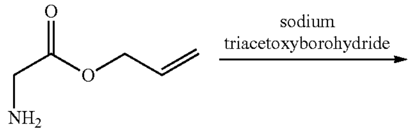

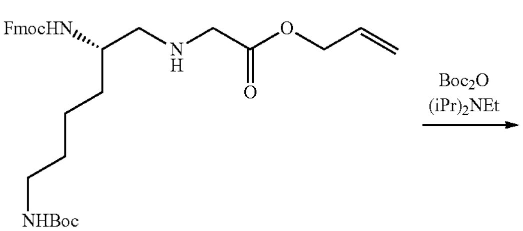

7

-continued

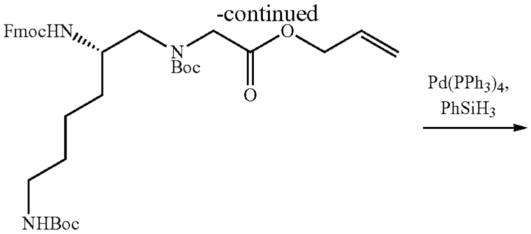

8

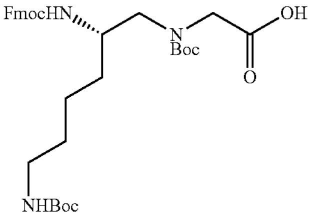

9

Preparation of Compound 5

N,N'-Dicyclohexylcarbodiimide (2.04 g, 9.90 mmol) and fmoc-lys(boc)-OH (4.22 g, 9.00 mmol) were added to a stirred mixture of N,O-dimethylhydroxylamine hydrochloride (0.97 g, 9.90 mmol) and triethylamine (1.38 mL, 9.90 mmol) in DCM (40 mL). The reaction mixture was stirred at RT for 2.5 h. The reaction mixture was cooled to −20° C. and filtered. The collected solid was washed with cold DCM and then discarded. The filtrate was washed with saturated aqueous sodium bicarbonate, dried over anhydrous magnesium sulfate, filtered, and concentrated in vacuo. The resulting crude product was purified via silica gel chromatography, eluting with 10% to 75% EtOAc in heptane, to give (S)-(9H-fluoren-9-yl)methyl tert-butyl (6-(methoxy(methyl)amino)-6-oxohexane-1,5-diyl)dicarbamate (5, 4.31 g, 91% yield) as an oil. LC/MS (ESI$^-$) m/z=534.2 (M+Na)$^+$.

Preparation of Compound 6

Lithium aluminum hydride (1.0M solution in THF, 3.29 mL, 3.29 mmol) was added dropwise to a solution of (S)-(9H-fluoren-9-yl)methyl tert-butyl (6-(methoxy(methyl)amino)-6-oxohexane-1,5-diyl)dicarbamate (5, 886 mg, 1.73 mmol) in THF (9 mL) at 0° C. This mixture was stirred for 45 min. before being quenched at 0° C. by the careful addition of aqueous 1M potassium bisulfate solution. The resulting biphasic mixture was separated and the aqueous layer was extracted with ethyl acetate (1×). The combined extracts were washed with water (1×), dried over anhydrous magnesium sulfate, filtered, and concentrated in vacuo to give (S)-allyl 2-((2-((((9H-fluoren-9-yl)methoxy)carbonyl)amino)-6-((tert-butoxycarbonyl)amino)hexyl)amino)acetate (6) as an oil. This material was taken to the next step without further purification.

Preparation of Compound 7

(S)-allyl 2-((2-((((9H-fluoren-9-yl)methoxy)carbonyl)amino)-6-((tert-butoxycarbonyl)amino)hexyl)amino)acetate (compound 6) was dissolved in DCM (4 mL) and cooled to 0° C. A solution of allyl 2-aminoacetate (0.20 g, 1.73 mmol) in DCM (1 mL) was added dropwise followed by sodium triacetoxyborohydride (0.44 g, 2.08 mmol). This mixture was stirred at 0° C. for 1 h, then quenched with saturated aqueous sodium bicarbonate. The resulting biphasic mixture was separated and the aqueous layer was extracted with DCM (1×). The combined organic extracts were dried over anhydrous magnesium sulfate, filtered, and concentrated in vacuo to give an oil that was purified by silica gel chromatography (50 to 100% EtOAc/heptane gradient) to give (S)-allyl 2-((2-((((9H-fluoren-9-yl)methoxy)carbonyl)amino)-6-((tert-butoxycarbonyl)amino)hexyl)amino)acetate (7, 0.51 g, 54% yield for two steps) as an oil. LC/MS ($ESI^-$) m/z=552.2 $(M+H)^+$.

Preparation of Compound 8

Hunig's base (0.19 mL, 1.11 mmol) and di-tert-butyl dicarbonate (0.22 g, 1.02 mmol) were added to a solution of (S)-allyl 2-((2-((((9H-fluoren-9-yl)methoxy)carbonyl)amino)-6-((tert-butoxycarbonyl)amino)hexyl)amino)acetate (7, 0.51 g, 0.92 mmol) in DCM (4 mL) under argon. The mixture was stirred for 4 h, at which time water was added and the product was extracted into DCM (3×). The combined extracts were dried over anhydrous magnesium sulfate, filtered, and concentrated in vacuo to give an oil. The oil was purified by silica gel chromatography (0 to 100% EtOAc/heptane gradient) to give (S)-allyl 2-((2-((((9H-fluoren-9-yl)methoxy)carbonyl)amino)-6-((tert-butoxycarbonyl)amino)hexyl)(tert-butoxycarbonyl)amino)acetate (7, 0.52 g, 86% yield) as an oil. LC/MS ($ESI^-$) m/z=674.2 $(M+Na)^+$.

Preparation of Compound 9

Tetrakis(triphenylphosphine)palladium(0) (91 mg, 0.078 mmol) and phenylsilane (0.19 mL, 1.57 mmol) were added to a degassed solution of (S)-allyl 2-((2-((((9H-fluoren-9-yl)methoxy)carbonyl)amino)-6-((tert-butoxycarbonyl)amino)hexyl)(tert-butoxycarbonyl)amino)acetate (8, 0.52 g, 0.78 mmol) in DCM (5 mL). The mixture was sparged with argon for 3 min and then stirred at RT for 2 h, at which time water was added and the product was extracted into DCM (2×). The combined extracts were dried over anhydrous magnesium sulfate, filtered, and concentrated in vacuo to give an oil. The oil was purified by silica gel chromatography (0 to 10% MeOH/DCM gradient) to give product as a brown solid. This solid was then dissolved in DCM (10 mL) and then a colored impurity was removed by stirring with siliabond DMT silica gel (300 wt %) for 1 h at 30° C. The silica gel was filtered off using celite and the filtrate was concentrated in vacuo to give (S)-2-((2-((((9H-fluoren-9-yl)methoxy)carbonyl)amino)-6-((tert-butoxycarbonyl)amino)hexyl)(tert-butoxycarbonyl)amino)acetic acid (9, 0.36 g, 76% yield) as a white solid. LC/MS ($ESI^-$) m/z=634.2 $(M+Na)^+$.

| Entry | Intermediate | Aldehyde | Preparation of aldehyde | Amine | Mass |
|---|---|---|---|---|---|
| 1[1] | 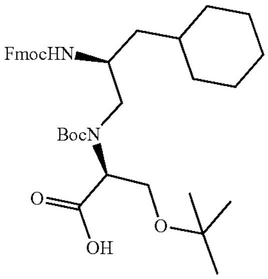 | 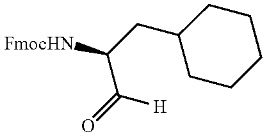 | Scheme 2 | 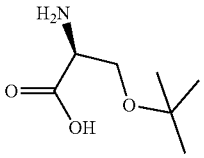 | 645.3 (M + Na) |
| 2 | 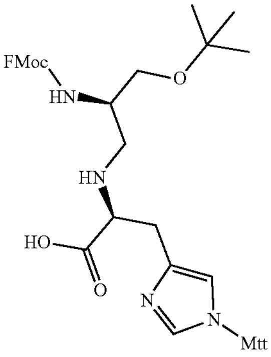 | 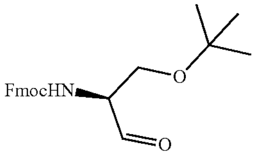 | Scheme 2 | 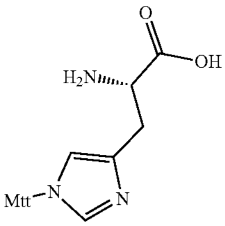 | 763.3 (M + H) |

-continued

| Entry | Intermediate | Aldehyde | Preparation of aldehyde | Amine | Mass |
|---|---|---|---|---|---|
| 3[2] | 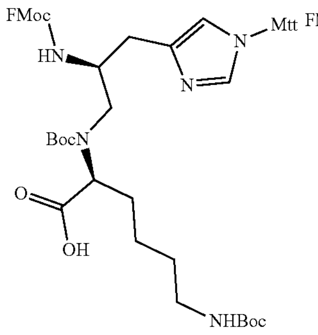 | 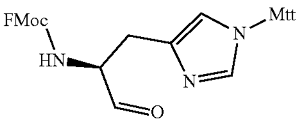 | Scheme 2 | 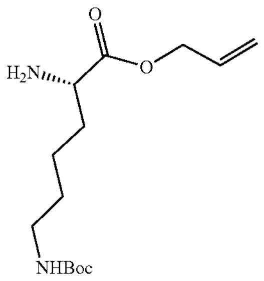 | 948.2 (M + H) |

[1]reductive amination carried out using $NaCNBH_3$ in 1:1 DCM/MeOH.

[2]Allyl ester deprotection carried out using $Pd(OAc)_2$, P(OEt)3, and dimedone, (Seki, M.; Kondo, K.; Kuroda, T.; Yamanaka, T.; Iwasaki, T., SynLett., 1995, 609-611).

SCHEME 3

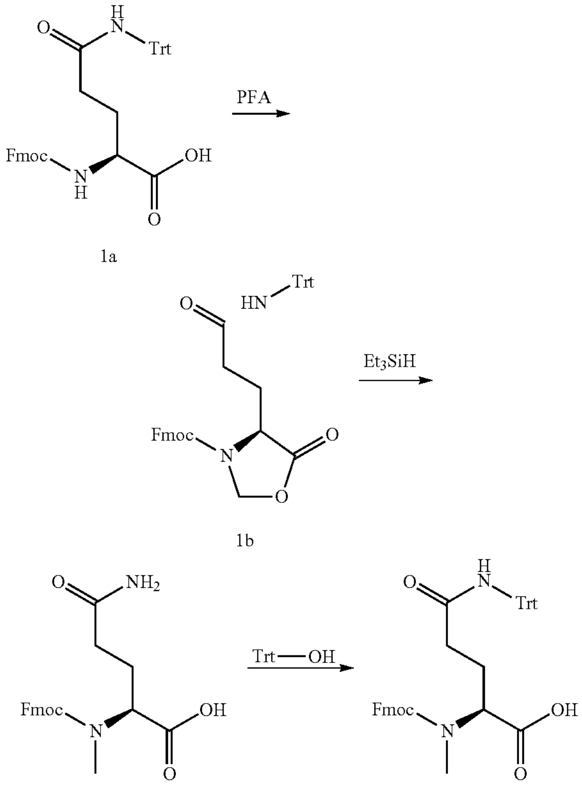

1a 1b 1c 1d

Preparation of Compound 1b

A suspension of commercially available (1a) (6.0 g, 9.82 mmol), paraformaldehyde (2.95 g, 29.5 mmol), 4-methylbenzene sulfonic acid, monohydrate (0.093 g, 0.491 mmol) in toluene (150 mL) was heated to 75° C. for 30 min. The solution was cooled to 20° C. then extracted with 500 $NaHCO_3$ (2×25 mL). The organic was dried over $MgSO_4$, filtered, then concentrated onto dry silica (10 g) under reduced pressure. The products were then purified by silica gel chromatography (220 g) eluting products with a gradient of 0 to 40% ethyl acetate/heptane to afford (S)-(9H-fluoren-9-yl)methyl 5-oxo-4-(3-oxo-3-(tritylamino)propyl)oxazolidine-3-carboxylate (1b, 5.95 g, 97% yield) as white solid. m/z (APCI, pos. ion) 645.2 (M+Na).

Preparation of Compound 1c

To a stirring solution of (1b) (5.95 g, 9.56 mmol) and triethylsilane (5.56 g, 47.8 mmol) in $CHCl_3$ (30 mL) at 20° C. was added trifluoroacetic acid (30 mL). The solution was stirred for 18 hrs at 40° C. The solvents were then removed under reduced pressure and the residue azeotroped with glacial AcOH (3×100 mL) to afford (S)-(9H-fluoren-9-yl) methyl 5-oxo-4-(3-oxo-3-(tritylamino)propyl)oxazolidine-3-carboxylate (1c) as white solid that was used on the next step without further purification. m/z (APCI, pos. ion) 383.1 (M+1).

Preparation of Compound 1d

To a stirring suspension (1c) (3.6 g, 9.41 mmol), triphenylmethanol (4.90 g, 18.83 mmol), acetic anhydride (1.922 g, 18.83 mmol) in glacial AcOH (40 mL) was added neat sulfuric acid (0.025 ml, 0.471 mmol) at 20° C. The yellowed mixture was then heated to 45° C. to create a solution and stirred for 18 hr. The reaction was then partitioned between ice water (200 mL) and EtOAc (200 mL). The organic was dried over $MgSO_4$, concentrated under reduced pressure, then purified by silica gel chromatography (220 g) eluting products with a gradient of 10 to 30% of 3:1 ethyl acetate/ethanol (solvent B) and heptane (solvent A) to afford (S)-2-((((9H-fluoren-9-yl)methoxy)carbonyl)(methyl)amino)-5-oxo-5-(tritylamino)pentanoic acid (1d, 3.85 g, 6.16 mmol, 65.5% yield) as white foam. m/z (APCI, pos. ion) 647.2 (M+Na).

N-methylation of the peptide backbone was also accomplished directly according to Scanlon et al. *Int. J Pept. Res. Ther.* 2008, 14, 381-386 or Biron et al. *J Peptide Sci.* 2006, 12, 213-219. Briefly, the resin supported peptide was treated with o-nitrobenzenesulfonyl chloride and 2,4,6-collidine followed by methyl p-nitrotriflate and MTBD or with triphenylphosphine, DIAD and methanol. The intermediate o-nitrobenzenesulfonamide was cleaved by treatment with mercaptoethanol and DBU.

A more detailed description of the preparation of the modified apelin polypeptides using solid phase peptide synthesis follows.

Experimental Method for Peptide Synthesis

Peptides were prepared on an Intavis MultiPep RSi automated high-throughput peptide synthesizer using $N^{\alpha}$-Fmoc solid-phase peptide synthesis (SPPS) methodologies with appropriate orthogonal protection and resin linker strategies. The peptides were synthesized on 0.1 mmol scale using pre-loaded Fmoc-amino acid resins. The remaining amino acids were added to the growing peptide chain by stepwise addition using standard solid phase methods in a 10 mL fritted reaction vessels. The $N^{\alpha}$-Fmoc group was removed from resin bound amino acid by addition of 20% piperidine solution in dimethylformamide (DMF, 1×5 min, 1×15 min). Coupling reactions proceeded by preactivation (5 min) of five-fold excess $N^{\alpha}$-Fmoc-amino acid, 5-fold excess diisppropylcarbodiimide (DIC), and 5-fold excess 1-Hydroxy-7-azabenzotriazole (HOAt) in peptide synthesis grade DMF followed by addition to the peptide-resin. The stock concentrations were 0.5 M amino acid, 1 M DIC, and 0.4 M HOAt. The resin mixture was mixed for 60 min per cycle, drained, and if a double couple cycle was used the coupling cycle was repeated prior to Fmoc removal. Upon complete formation of the protected peptide, the final $N^{\alpha}$-Fmoc protecting group was removed as described above. N-terminal acylations were performed as described for amino acid coupling. N-terminal acetylations were performed with 3 mL of 10% acetic anhydride and 0.5 mL 1.25 M DIEA in DMF for 1 h. Peptides with lipidation at peptide backbone residues were prepared by first removing Mtt from the Lys(Mtt) residue with a 2% TFA/5% Tis in DCM solution (5×10 min), neutralization of the epsilon amine with 10% DIEA in DCM (2×5 min), followed by acylations as described above for amino acid coupling cycles. Peptide-resins were washed with DMF (4×), DCM (6×), and dried thoroughly in vacuo prior to cleavage.

Experimental Method for Deprotection & Cleavage from Solid Support

The peptides were cleaved from the resin by agitating each peptide-resin 5 mL of a solution of trifluoroacetic acid (TFA, 87.5%), triisopropylsilane (Tis, 5%), water (2.5%), Anisole (1%), and thioanisole (1%) for 2 h at room temperature. The crude peptide TFA solutions were transferred to tarred 50 mL conical tubes by filtration using a Biotage Syro cleavage device, the resins washed with 5 mL of the TFA solution, and the filtrates combined. The combined filtrates were concentrated in the 50 mL conical polypropylene tubes by vacuum centrifugation for 2 h (Genevac HT-12), and the crude peptides were recovered by precipitation with cold anhydrous ethyl ether giving a white to amber colored precipitate. The 50 mL conical tubes were centrifuged @ 3000 RPM for 4 min, the ether decanted, the precipitants washed with additional 50 mL cold ether, centrifuged, decanted, and then dried in vacuo prior to analytical LCMS analysis.

Method for Analytical Analysis of Crude Peptides

Crude peptides were dissolved in 50% ACN in $H_2O$ (0.1% TFA) and the solutions filtered with 0.45 um syringe filters. Crude analysis samples were prepared for LCMS analysis by making 10-fold dilutions in 50% ACN in $H_2O$ (0.1% TFA). Peptides were analyzed by analytical LCMS by elution from a Phenomenex Kinetex C18 column (1.7 μm, 2.1×50 mm). Acetylated peptides were characterized using a linear gradient of 5-50% ACN in $H_2O$ (0.1% TFA) over 3 min at a flow rate of 1000 μL/min. PEGylated and lipidated peptides were characterized using a linear gradient of 20-65% ACN in $H_2O$ (0.1% TFA) over 3 min at a flow rate of 1000 μL/min.

General Method for Purification

Peptides were purified by preparative reverse-phase high-pressure liquid chromatography (RP-HPLC) by elution from a YMC Triart C18 column (5 um, 30×250 mm). The typical method consisted of a 4 min hold at equilibration conditions followed by a linear gradient of 0.333% increase of acetonitrile in $H_2O$ (0.1% TFA) over 56 min @ 40 mL/min. The high purity fractions corresponding to correct products were collected, combined, concentrated in vacuo, and lyophilized to afford an amorphous solid.

General Method for Characterization

Purified products were analyzed for purity and MW verification on an Agilent 1290 LC-MS system by elution from a Phenomenex Max-RP column (2.5 μm, 2.0×50 mm). Acetylated peptides were characterized using a linear gradient of 5-50% ACN in $H_2O$ (0.1% TFA) over 10 min at a flow rate of 700 μL/min. PEGylated and lipidated peptides were characterized using a linear gradient of 20-65% ACN in $H_2O$ (0.1% TFA) over 10 min at a flow rate of 700 μL/min. Peptides were quantified by Chemiluminescent Nitrogen Detection (CLND). Peptides with ≥95% purity at 214 nM and with theoretical mass observed were registered in the database and submitted for additional in vitro and in vivo characterization as described in the following examples.

Example 2. Preparation of Lipidated Apelin Polypeptides

Lipidation of the modified apelin polypeptides is one strategy for extending the half-life of the modified polypeptides in vivo. A generic description of the strategy follows:

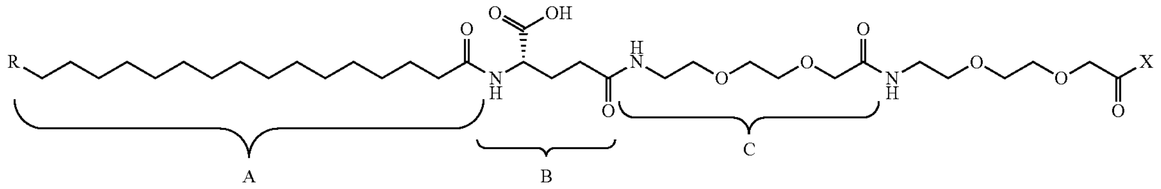

A represents a fatty acyl group, where R=carboxylic acid, amine, hydroxyl, ester, alkene, alkyne, or methyl. B represents γGlu (α-carboxy-4-aminobutyric acid; AC4Abu) for acidity & solubility. C is a short PEG group, such as [2-(2-Amino-ethoxy)-ethoxy]-acetic acid (Aeea) for flexibility & solubility. X=point of covalent attachment to the apelin polypeptide. As independent or joint constituents B and C comprise the conjugation linker. The conjugation linker is not critical to achieve half-life protraction and does not contribute to the intrinsic APJ agonist activity of the apelin polypeptide but serves a spatial, functional and/or structural role between the fatty acyl half-life extension moiety and the apelin polypeptide. In this regard the conjugation linker may be absent or can be substituted with any other moiety that accomplishes the covalent attachment of the fatty acyl half-life extension group.

Fatty acids are covalently attached to the N-terminus, or amino acids corresponding to positions 70 or 71 in the apelin preprotein (SEQ ID NO: 2), or other sites in the peptide. The fatty acyl group can be attached directly to the polypeptide or with a spacer such as: AEEA (small PEG group), AEEA-AEEA, γGlu-AEEA, γGlu-AEEA-AEEA, γGlu, or other amino acid. The alkyl chain of the fatty acid is typically composed of 2 to 24 methylene units. Various modified apelin polypeptides were conjugated to several different fatty acyl groups according to this strategy and the resulting lipidated polypeptides were tested for APJ receptor agonist activity as described in Examples 3 and 10. It should be noted that the apelin polypeptides in the sequences below and described herein, without conjugation (e.g. without conjugation to a fatty acyl group) may also serve as APJ agonists.

Example 3. APJ Agonist Activity of Modified Apelin Polypeptides

Greater than 800 modified peptides were used in structure-activity relationship assays to optimize for potency and metabolic stability relative to the endogenous ligand of the APJ receptor, pyr apelin-13 (SEQ ID NO: 6). Compounds were screened up to 10 μM along with pyr apelin-13, which was used as a positive control. Compounds that showed functional activity in all the SAR assays were deemed positive and re-screened. The iterative process was continued and peptides were further modified for optimization.

Two different assays, which are described below, were employed to assess the APJ agonist activity of the modified apelin polypeptides. The cAMP assay involves measuring changes in intracellular cAMP as a result of activation of the APJ receptor. Activation of the APJ receptor by endogenous ligand pyr-apelin results in a decrease in intracellular cAMP. The second assay, which is the GTPγS assay, measures the coupling of G protein to the APJ receptor when bound to an agonist. Thus, extent of decrease in cAMP levels and efficacy of G protein bound to agonist receptor complex is used to assess the extent of agonist activity of the modified apelin polypeptides.

cAMP Assay

Stable CHO cell lines expressing the human or rat APJ receptor were incubated with stimulation buffer containing HANK's buffer, forskolin and 0.5 mM IBMX in the absence or presence of various concentrations of peptides at 37° C. for 45 min. The cAMP level was determined using a cyclic AMP kit (Cisbio cAMP kit) according to the manufacturer's instructions.

[35S] GTPγS Assay

To assay for GTPγS bound to receptor, membranes were prepared from stable cell lines expressing the human or rat APJ receptor and the receptor bound to the non-hydrolyzable GTP (GTPγS) was used to determine the efficacy/potency of the modified peptides. The optimal experimental conditions for the concentrations of GDP, $MgCl_2$ and NaCl in the assay buffer were initially determined. The membranes were incubated with modified peptides in the assay buffer. The reaction was initiated by addition of [$^{35}$S] GTPγS in the absence or presence of peptides and incubated at room temperature for 90 min. Non-specific binding was determined in the presence of excess cold GTPγS and was always less than 0.2% of total binding. Bound [$^{35}$S] GTPγS was separated from free radiolabel by filtration. The filter bound radioactivity was determined by liquid scintillation counting. GTPγS assay results for various modified apelin polypeptides are shown in Table 11 below. EC50 values are provided for each modified polypeptide for activation of the human and rat APJ receptors

TABLE 11

APJ Agonist Activity of Modified Apelin Polypeptides

| SEQ ID NO: | SEQUENCE | EC50Human APJ Receptor (μM) | EC50Rat APJ Receptor (μM) |
|---|---|---|---|
| 6 [pyr-apelin] | {Hydrogen}[PEJRPRLSHKGPMPF{COOH} | .0046608 | .023416 |
| 16 | Acetyl-[hArg][r]Q[hArg]P[r][NMeLeu]SHKG[Oic][pI-Phe]P[D-Bip]{COOH} | .000375 | .00072863 |
| 17 | Acetyl-RQRP[hArg][Cha]SHKG[Oic][Nle]P[4-Cl-F]{COOH} | .00017065 | .001588 |
| 18 | Acetyl-[r][hArg]Q[hArg]P[r][NMeLeu]SHKG[Oic][pI-Phe]P[D-Bip]{COOH} | .00046783 | .000523 |
| 19 | Acetyl-[hArg][hArg][q][hArg]P[r][NMeLeu]SHKG[Oic][pI-Phe]P[D-Bip]{COOH} | .00053333 | .00075733 |
| 20 | Acetyl-[hArg][hArg]Q[r]P[r][NMeLeu]SHKG[Oic][pI-Phe]P[D-Bip]{COOH} | .000189 | .000706 |
| 21 | Acetyl-[hArg][hArg]Q[hArg][Oic][r][NMeLeu]SHKG[Oic][pI-Phe]P[D-Bip]{COOH} | .00057 | .0018 |
| 22 | Acetyl-[hArg][hArg]Q[r]P[NMeArg][Cha]SHKG[Oic][pI-Phe]P[D-Bip]{COOH} | .0015167 | .0045233 |

TABLE 11-continued

| APJ Agonist Activity of Modified Apelin Polypeptides | | | |
|---|---|---|---|
| SEQ ID NO: | SEQUENCE | EC50Human APJ Receptor (μM) | EC50Rat APJ Receptor (μM) |
| 23 | Acetyl-[hArg]Q[r]P[NMeArg][Cha]SHKG[Oic][Nle]P[4-Cl-F]{COOH} | 0.000384 | 0.0322 |
| 24 | Acetyl-[hArg]Q[r]P[NMeArg][Cha]SHKG[Oic][Nle]P[D-4CIF]{COOH} | 0.00787 | 0.134 |
| 25 | Acetyl-[hArg]Q[r]P[NMeArg][Cha]SHKG[Oic][Nle][D-1Nal]{COOH} | 0.001735 | 0.053675 |
| 29 | Acetyl-OF[hArg][hArg][BLeu][hArg]P[hArg][Cha]SHKG[Oic][Nle]P[4-Cl-F]{COOH} | .0001155 | .00030133 |
| 30 | Acetyl-OF[hArg][hArg]Q[hArg]P[hArg][BLeu]SHKG[Oic][Nle]P[4-Cl-F]{COOH} | .000166 | .00045633 |
| 31 | {Acetyl}OF[hArg][hArg]Q[hArg]P[hArg][Cha][NhSerG]HKG[Oic][Nle]P[4-Cl-F]{COOH} | 0.0001155 | 0.000703 |
| 32 | {Acetyl}OF[hArg][hArg]Q[hArg]P[hArg][Cha]SH[NLysG]G[Oic][Nle]P[4-Cl-F]{COOH} | 0.00025033 | 0.001514 |
| 33 | {Acetyl}OF[hArg][hArg]Q[hArg][aMePro][hArg][Cha]SHKG[Oic][Nle]P[4-Cl-F]{COOH} | 0.000098533 | 0.00031767 |
| 34 | {Acetyl}OF[hArg][hArg]Q[hArg]P[hArg][aMeLeu]SHKG[Oic][Nle]P[4-Cl-F]{COOH} | 0.000051933 | 0.00019267 |
| 35 | {Acetyl}OF[hArg][hArg]Q[hArg]P[hArg][Cha][aMeS]HKG[Oic][Nle]P[4-Cl-F]{COOH} | 0.000086117 | 0.00018455 |
| 36 | {Acetyl}OF[hArg][hArg]Q[hArg]P[hArg][Cha]SH[aMeOrn]G[Oic][Nle]P[4-Cl-F]{COOH} | 0.00035467 | 0.0019433 |
| 37 | {Acetyl}OF[hArg][hArg]Q[hArg]P[hArg][Cha]SHKG[Oic][Nle][aMePro][4-Cl-F]{COOH} | 0.0000672 | 0.00013573 |
| 38 | {Acetyl}OF[hArg][hArg]Q[rhArg]P[hArg][Cha]SHKG[Oic][Nle]P[4-Cl-F]{COOH} | 0.000086933 | 0.0013 |
| 39 | {Acetyl}OF[hArg][hArg]Q[hArg]P[rhArg][Cha]SHKG[Oic][Nle]P[4-Cl-F]{COOH} | 0.00025267 | 0.00032333 |
| 40 | {Acetyl}OF[hArg][hArg]Q[hArg]P[hArg][Cha]S[rHis]KG[Oic][Nle]P[4-Cl-F]{COOH} | 0.00023367 | 0.00145 |
| 41 | {Acetyl}OF[hArg][hArg]Q[hArg]P[hArg][Cha]SH[rLys]G[Oic][Nle]P[4-Cl-F]{COOH} | 0.00015097 | 0.000817 |
| 42 | {Acetyl}OF[hArg][hArg]Q[hArg]P[hArg][rCha]SHKG[Oic][Nle]P[4-Cl-F]{COOH} | 0.000044933 | 0.000247 |
| 43 | {Acetyl}OF[hArg][hArg]Q[hArg]P[hArg][Cha][rSer]HKG[Oic][Nle]P[4-Cl-F]{COOH} | 0.000393 | 0.0018267 |
| 44 | {Acetyl}OF[hArg][hArg]Q[hArg]P[hArg][Cha][DrSer]HKG[Oic][Nle]P[4-Cl-F]{COOH} | 0.00099667 | 0.00379 |
| 46 | {Acetyl-NH}OF[hArg][hArg]QRP[hArg][Cha]SHKGP[pI-Phe]P[D-Bip]{COOH} | .0003895 | .0010408 |
| 47 | {Acetyl-NH}OF[hArg][hArg]QRP[hArg][NMeLeu]SHKG[Oic][p]-Phe]P[D-Bip]{COOH} | .00041633 | .00063017 |
| 48 | {Acetyl-NH}OF[hArg][hArg]QRP[hArg][Cha]SHKGP[Nle][4-Cl-F]{COOH} | 0.00028683 | 0.0004865 |
| 49 | {Acetyl-NH}OF[hArg][hArg]QRP[hArg][Cha]SHKGP[Nle][2-Nal]{COOH} | 0.00015867 | 0.000291 |
| 50 | {Acetyl-NH}rQ[hArg]Pr[NMeLeu]SHKG[Oic][pI-Phe]P[D-Bip]{COOH} | 0.0014333 | 0.0016767 |

TABLE 11-continued

APJ Agonist Activity of Modified Apelin Polypeptides

| SEQ ID NO: | SEQUENCE | EC50Human APJ Receptor (μM) | EC50Rat APJ Receptor (μM) |
|---|---|---|---|
| 51 | {Acetyl-NH}RQRP[hArg][NMeLeu]SHKG[Oic][pI-Phe]P[D-Bip]{COOH} | 0.00037 | 0.0012615 |
| 52 | {Acetyl-NH}rQRP[hArg][NMeLeu]SHKG[Oic][pI-Phe]P[D-Bip]{COOH} | 0.000623 | 0.001144 |
| 53 | {Acetyl-NH}Q[hArg]Pr[NMeLeu]SHKG[Oic][pI-Phe]P[D-Bip]{COOH} | 0.00518 | 0.005984 |
| 54 | {Acetyl-NH}QrP[NMeArg][Cha]SHKG[Oic][Nle][D-1Nal]{COOH} | 0.030122 | 0.31175 |
| 55 | {Acetyl-NH}q[hArg]P[NMeArg][Cha]SHKG[Oic][Nle]P[D-4CIF]{COOH} | 0.031578 | 0.14514 |
| 56 | {Acetyl-NH}[hArg][hArg]Q[hArg]P[NMeArg][Cha]SHKG[Oic][Nle]P[4-Cl-F]{COOH} | 0.0001755 | 0.00091483 |
| 57 | {Acetyl-NH}OF[hArg][hArg]Q[hArg]P[NMeArg][Cha]SHKG[Oic][Nle][4-Cl-F]{COOH} | 0.00041167 | 0.00078667 |
| 58 | {Acetyl-NH}OF[hArg][hArg]Q[hArg][Oic]r[Cha]SHKG[Oic][Nle][4-Cl-F]{COOH} | 0.0011692 | 0.005315 |
| 59 | {Acetyl-NH}OF[hArg][hArg]Q[hArg]Pr[NMeLeu]SHKG[Oic][Nle][4-Cl-F]{COOH} | 0.0020833 | 0.0045733 |
| 96 | {H2}[PE]RP[hArg][Cha][Pra](NPeg9)HKG[Oic][Nle]P[4-Cl-F]{COOH} | .0020206 | .014617 |
| 97 | [MerPr](20KmPEGacetamide)KFRRQRP[hArg][Cha]SHKG[Oic][Nle]P[4-Cl-F]{COOH} | .00020267 | .000253 |
| 100 | {H2}[MerPr](20KmPEGacetamide)RQRP[hArg][Cha]SHKG[Oic][Nle]P[4-Cl-F]{COOH} | 0.00806 | 0.0454 |
| 101 | {H2}[MerPr](20KmPEGacetamide)QRP[hArg][Cha]SHKG[Oic][Nle]P[4-Cl-F]{COOH} | 0.046667 | 0.1496 |
| 102 | {Npeg11}KFRRQRP[hArg][Cha]SHKG[Oic][Nle]P[4-Cl-F]{COOH} | .000083033 | .00017967 |
| 103 | {H2}[3TP](20K-mPEGReg)[hArg]rQ[hArg]Pr[NMeLeu]SHKG[Oic][pI-Phe]P[D-Bip]{COOH} | .034233 | .0522 |
| 104 | {H2}[3TP](20K-mPEGReg)[hArg]RQ[hArg]PR[NMeLeu]SHKG[Oic][pI-Phe]P[D-Bip]{COOH} | .018867 | .045033 |
| 105 | {Acetyl}[Atz(20K-mPEG)]KFRRQRP[hArg][Cha]SHKG[Oic][Nle]P[4-Cl-F]{COOH} | .000187 | .000285 |
| 106 | {Acetyl}[Atz(20K-mPEG)]LRP[hArg][Cha]SHKG[Oic][Nle]P[4-Cl-F]{COOH} | .0032235 | .0473 |
| 107 | {Acetyl-NH}[Pra](20K-mPEGReg)OF[hArg][hArg]QRP[hArg][NMeLeu]SHKG[Oic][pI-Phe]P[D-Bip]{COOH} | .010547 | .010047 |
| 126 | {TDA}[AC4Abu][Aeea][Aeea][q][hArg]P[NMeArg][Cha]SHKG[Oic][Nle]P[f]{COOH} | .011 | .056167 |
| 149 | {TDA}[AC4Abu][Aeea][Aeea][hArg][q][hArg]P[NMeArg][Cha]SHKG[Oic][Nle]P[f]{COOH} | 0.0031867 | 0.0099867 |
| 153 | {TDA}[AC4Abu][Aeea][Aeea][r]Q[hArg]P[r][NMeLeu]SHKG[Oic][pI-Phe]P[Oic]{COOH} | 0.003755 | 0.07205 |
| 154 | {TDA}[AC4Abu][Aeea][Aeea][r]Q[hArg]P[r][NMeLeu]SHKG[Oic][pI-Phe]P[D-4CIF]{COOH} | 0.00454 | 0.04045 |
| 155 | {TDA}[AC4Abu][Aeea][Aeea][r]Q[hArg]P[r][NMeLeu]SHKG[Oic][p]-Phe]P[D-1Nal]{COOH} | 0.008625 | 0.0496 |

TABLE 11-continued

APJ Agonist Activity of Modified Apelin Polypeptides

| SEQ ID NO: | SEQUENCE | EC50Human APJ Receptor (μM) | EC50Rat APJ Receptor (μM) |
|---|---|---|---|
| 165 | {TDA}[AC4Abu][Aeea][Aeea][hArg]Q[r]P[NMeArg][Cha]SHKG[Oic][Nle][D-1Nal]{COOH} | .00116 | .030267 |
| 173 | {TDA}[AC4Abu][Aeea][Aeea][r]Q[hArg]P[r][NMeLeu]SHKG[Oic][p]-Phe][D-Bip]{COOH} | 0.001655 | 0.01367 |
| 174 | {TDA}[AC4Abu][Aeea][Aeea][hArg][q][hArg]P[r][NMeLeu]SHKG[Oic][pI-Phe][D-Bip]{COOH} | 0.003605 | 0.01655 |
| 175 | {TDA}[AC4Abu][Aeea][Aeea][hArg]Q[r]P[r][NMeLeu]SHKG[Oic][pI-Phe][D-Bip]{COOH} | 0.001325 | 0.008545 |
| 180 | {TDA}[AC4Abu][Aeea][Aeea][hArg][q][hArg]P[r][BLeu]SHKG[Oic][pI-Phe]P[D-Bip]{COOH} | 0.01004 | 0.0273 |
| 199 | {TDA}[AC4Abu][Aeea][Aeea][hArg][q][hArg]P[r][NMeLeu]SAKG[Oic][pI-Phe]P[D-Bip]{COOH} | 0.00848 | 0.0324 |
| 201 | {TDA}[AC4Abu][Aeea][Aeea][hArg][q][hArg]P[r][NMeLeu]S[Tle]KG[Oic][pI-Phe]P[D-Bip]{COOH} | 0.0494 | 0.1825 |
| 208 | {TDA}[AC4Abu][Aeea][Aeea][hArg][q][hArg]P[r][NMeLeu][bAla]HKG[Oic][pI-Phe]P[D-Bip]{COOH} | 0.0289 | 0.104 |
| 211 | {TDA}[AC4Abu][Aeea][Aeea]RQRP[r][NMeLeu]SHKG[Oic][pI-Phe]P[D-Bip]{COOH} | 0.0019033 | 0.0062867 |
| 212 | {TDA}[AC4Abu][Aeea][Aeea]RQRP[hArg][NMeLeu]SHKG[Oic][pI-Phe]P[D-Bip]{COOH} | .00051533 | .0013663 |
| 213 | {TDA}[AC4Abu][Aeea][Aeea][r]QRP[hArg][NMeLeu]SHKG[Oic][pI-Phe]P[D-Bip]{COOH} | .00064667 | .0011737 |
| 214 | {TDA}[AC4Abu][Aeea][Aeea]RQRP[hArg][Cha]SHKG[Oic][pI-Phe]P[D-Bip]{COOH} | 0.0029233 | 0.0058067 |
| 215 | {TDA}[AC4Abu][Aeea][Aeea][r]QRP[r][Cha]SHKG[Oic][pI-Phe]P[D-Bip]{COOH} | 0.0084233 | 0.0214 |
| 216 | {TDA}[AC4Abu][Aeea][Aeea]RQRP[r][Cha]SHKG[Oic][pI-Phe]P[D-Bip]{COOH} | 0.01076 | 0.0225 |
| 217 | {TDA}[AC4Abu][Aeea][Aeea][r]QRP[hArg][Cha]SHKG[Oic][pI-Phe]P[D-Bip]{COOH} | 0.0046667 | 0.00883 |
| 218 | {TDA}[AC4Abu][Aeea][Aeea][r]Q[hArg]P[r][NMeLeu]SHKG[Oic][Nle]P[4-Cl-F]{COOH} | .00084133 | .014933 |
| 219 | {TDA}[AC4Abu][Aeea][Aeea][r]Q[hArg]P[r][NMeLeu]SHKG[Oic][pI-Phe]P[4-Cl-F]{COOH} | 0.010143 | 0.045 |
| 220 | {TDA}[AC4Abu][Aeea][Aeea][r]Q[hArg]P[r][NMeLeu]SHKG[Oic][Nle]P[D-Bip]{COOH} | 0.0027233 | 0.0276 |
| 221 | {TDA}[AC4Abu][Aeea][Aeea][r]Q[hArg]P[r][Cha]SHKG[Oic][Nle]P[4-Cl-F]{COOH} | .00019567 | .00193 |
| 222 | {TDA}[AC4Abu][Aeea][Aeea]QRP[hArg][NMeLeu]SHKG[Oic][pI-Phe]P[D-Bip]{COOH} | .0012267 | .0068667 |
| 223 | {TDA}[AC4Abu][Aeea][Aeea]QRP[hArg][Cha]SHKG[Oic][pI-Phe]P[D-Bip]{COOH} | 0.011257 | 0.052767 |
| 224 | {TDA}[AC4Abu][Aeea][Aeea]QRP[r][Cha]SHKG[Oic][pI-Phe]P[D-Bip]{COOH} | 0.028167 | 0.1025 |
| 225 | {TDA}[AC4Abu][Aeea][Aeea]Q[hArg]P[r][NMeLeu]SHKG[Oic][Nle]P[4-Cl-F]{COOH} | 0.0030233 | 0.0479 |
| 226 | {TDA}[AC4Abu][Aeea][Aeea]Q[hArg]P[r][NMeLeu]SHKG[Oic][p]-Phe]P[4-Cl-F]{COOH} | 0.020767 | 0.091 |

TABLE 11-continued

APJ Agonist Activity of Modified Apelin Polypeptides

| SEQ ID NO: | SEQUENCE | EC50Human APJ Receptor (μM) | EC50Rat APJ Receptor (μM) |
|---|---|---|---|
| 227 | {TDA}[AC4Abu][Aeea][Aeea]Q[hArg]P[r][NMeLeu]SHKG[Oic][Nle]P[D-Bip]{COOH} | 0.00877 | 0.097533 |
| 228 | {TDA}[AC4Abu][Aeea][Aeea]Q[hArg]P[r][Cha]SHKG[Oic][Nle]P[4-Cl-F]{COOH} | .00048433 | .00791 |
| 229 | {TDA}[AC4Abu][Aeea][Aeea][hArg]Q[r]P[NMeArg][Cha]SHKG[Oic][Nle]P[4-Cl-F]{COOH} | .00023533 | .00329 |
| 230 | {TDA}[AC4Abu][Aeea][Aeea][hArg]Q[r]P[NMeArg][Cha]SHKG[Oic][Nle]P[D-4CIF]{COOH} | .0013667 | .013833 |
| 234 | {HDA}[AC4Abu][Aeea][Aeea]Q[r]P[NMeArg][Cha]SHKG[Oic][Nle][Pip][4-Cl-F]{COOH} | .0060533 | .0125 |
| 237 | {HDA}[AC4Abu][Aeea][Aeea][q][hArg]P[NMeArg][Cha]SHKG[Oic][Nle]P[D-4CIF]{COOH} | .0049633 | .0048933 |
| 238 | {HDA}[AC4Abu][Aeea][Aeea]Q[r]P[NMeArg][Cha]SHKG[Oic][Nle]P[Tic]{COOH} | .00668 | .0285 |
| 239 | {HDA}[AC4Abu][Aeea][Aeea][hArg]Q[r]P[NMeArg][Cha]SHKG[Oic][Nle][Pip][4-Cl-F]{COOH} | .00145 | .0086067 |
| 242 | {HDA}[AC4Abu][Aeea][Aeea][hArg][q][hArg]P[NMeArg][Cha]SHKG[Oic][Nle]P[D-4CIF]{COOH} | .00219 | .00227 |
| 243 | {HDA}[AC4Abu][Aeea][Aeea][hArg]Q[r]P[NMeArg][Cha]SHKG[Oic][Nle]P[Tic]{COOH} | 0.0011922 | 0.010252 |
| 244 | {TDA}[AC4Abu][Aeea][Aeea]Q[r]P[NMeArg][Cha]SHKG[Oic][Nle]P[Tic]{COOH} | 0.010297 | 0.28067 |
| 257 | {TDA}[AC4Abu][Aeea][Aeea]OF[hArg][hArg]QRP[hArg][NMeLeu]SHKG[Oic][Nle][2Nal]{COOH} | .0014853 | .003135 |
| 258 | {PDA}[AC4Abu][Aeea][Aeea]OF[hArg][hArg]QRP[hArg][NMeLeu]SHKG[Oic][Nle][2Nal]{COOH} | .0017533 | .0025717 |
| 259 | {HDA}[AC4Abu][Aeea][Aeea]OF[hArg][hArg]QRP[hArg][NMeLeu]SHKG[Oic][Nle][2Nal]{COOH} | .0025917 | .0020917 |
| 260 | {ODDA}[AC4Abu][Aeea][Aeea]OF[hArg][hArg]QRP[hArg][NMeLeu]SHKG[Oic][Nle][2Nal]{COOH} | .048533 | .07495 |
| 261 | {TDA}[AC4Abu][Aeea][Aeea][hArg]rQ[hArg]Pr[NMeLeu]SHKG[Oic][pI-Phe]P[D-Bip]{COOH} | .0047383 | .009375 |
| 262 | {PDA}[AC4Abu][Aeea][Aeea][hArg]rQ[hArg]Pr[NMeLeu]SHKG[Oic][pI-Phe]P[D-Bip]{COOH} | .0044233 | .0067133 |
| 263 | {HDA}[AC4Abu][Aeea][Aeea][hArg]rQ[hArg]Pr[NMeLeu]SHKG[Oic][pI-Phe]P[D-Bip]{COOH} | .0039922 | .00591 |
| 264 | {ODDA}[AC4Abu][Aeea][Aeea][hArg]rQ[hArg]Pr[NMeLeu]SHKG[Oic][p]-Phe]P[D-Bip]{COOH} | .1449 | .19333 |
| 265 | {TDA}[AC4Abu][Aeea][Aeea]q[hArg]Pr[Cha]SHKG[Oic][Nle]P[D-4CIF]{COOH} | 0.0012 | 0.01447 |
| 266 | {TDA}[AC4Abu][Aeea][Aeea]QrPr[Cha]SHKG[Oic][Nle]P[D-4CIF]{COOH} | 0.00581 | 0.03325 |
| 267 | {TDA}[AC4Abu][Aeea][Aeea]QrP[NMeArg][Cha]SHKG[Oic][Nle]P[4-Cl-F]{COOH} | .00075333 | .0176 |
| 269 | {TDA}[AC4Abu][Aeea][Aeea]q[hArg]Pr[Cha]SHKG[Oic][Nle]P[D-Tic]{COOH} | 0.073 | 0.0523 |
| 270 | {TDA}[AC4Abu][Aeea][Aeea]q[hArg]Pr[Cha]SHKG[Oic][Nle][Aib][4-Cl-F]{COOH} | 0.001755 | 0.001489 |

TABLE 11-continued

APJ Agonist Activity of Modified Apelin Polypeptides

| SEQ ID NO: | SEQUENCE | EC50Human APJ Receptor (μM) | EC50Rat APJ Receptor (μM) |
|---|---|---|---|
| 271 | {TDA}[AC4Abu][Aeea][Aeea]q[hArg]Pr[Cha]SHKG[Oic][Nle][Deg][4-Cl-F]{COOH} | 0.0118 | 0.007875 |
| 272 | {TDA}[AC4Abu][Aeea][Aeea]q[hArg]Pr[Cha]SHKG[Oic][Tle]P[4-Cl-F]{COOH} | 0.01675 | 0.01155 |
| 273 | {TDA}[AC4Abu][Aeea][Aeea]q[hArg]Pr[Cha]S[Aib]KG[Oic][Nle]P[4-Cl-F]{COOH} | 0.001665 | 0.00509 |
| 274 | {TDA}[AC4Abu][Aeea][Aeea]q[hArg]Pr[BLeu]SHKG[Oic][Nle]P[4-Cl-F]{COOH} | 0.008045 | 0.0462 |
| 275 | {TDA}[AC4Abu][Aeea][Aeea]q[hArg]P[NMeArg][BLeu]SHKG[Oic][Nle]P[4-Cl-F]{COOH} | 0.0034275 | 0.019342 |
| 277 | {TDA}[AC4Abu][Aeea][Aeea]][hArg]Pr[Cha]SHKG[Oic][Nle]P[4-Cl-F]{COOH} | 0.016145 | 0.0209 |
| 278 | {TDA}[AC4Abu][Aeea][Aeea][BLeu][hArg]Pr[Cha]SHKG[Oic][Nle]P[4-Cl-F]{COOH} | 0.01006 | 0.0145 |
| 279 | {TDA}[AC4Abu][Aeea][Aeea]Q[NMeArg]Pr[Cha]SHKG[Oic][Nle]P[4-Cl-F]{COOH} | 0.00329 | 0.019275 |
| 280 | {TDA}[AC4Abu][Aeea][Aeea]q[NMeArg]Pr[Cha]SHKG[Oic][Nle]P[4-Cl-F]{COOH} | 0.002045 | 0.00447 |
| 281 | {TDA}[AC4Abu][Aeea][Aeea]q[hArg]Pr[BLeu]SHKG[Oic][Nle]P[D-4ClF]{COOH} | 0.0148 | 0.08735 |
| 282 | {TDA}[AC4Abu][Aeea][Aeea]q[hArg]Pr[Cha]SHKG[Oic][Nle][4-Cl-F]{COOH} | 0.00579 | 0.0133 |
| 283 | {TDA}[AC4Abu][Aeea][Aeea]q[hArg]Pr[Cha]SHKG[Oic][Nle][D-4ClF]{COOH} | 0.00974 | 0.0156 |
| 284 | {TDA}[AC4Abu][Aeea][Aeea]QrP[NMeArg][Cha]SHKG[Oic][Nle]P[D-4ClF]{COOH} | >4.17 | 4.17 |
| 285 | {TDA}[AC4Abu][Aeea][Aeea]QrP[NMeArg][Cha]SHKG[Oic][Nle][D-1Nal]{COOH} | .0082233 | .122 |
| 669 | OF[NMeArg][hArg]Q[hArg]P[hArg][Cha]SHKG[Oic][Nle]P[4-Cl-F] | 0.0053033 | 0.0055933 |
| 670 | OF[hArg][NMeArg]Q[hArg]P[hArg][Cha]SHKG[Oic][Nle]P[4-Cl-F] | 0.00013127 | 0.000254 |
| 671 | OF[hArg][hArg]Q[NMeArg]P[hArg][Cha]SHKG[Oic][Nle]P[4-Cl-F] | 0.00016167 | 0.00038733 |
| 672 | OF[hArg][hArg]Q[NMeArg]P[NMeArg][Cha]SHKG[Oic][Nle]P[4-Cl-F] | 0.00044483 | 0.00084467 |
| 673 | OF[hArg][NMeArg]Q[NMeArg]P[NMeArg][Cha]SHKG[Oic][Nle]P[4-Cl-F] | 0.0013433 | 0.0013433 |
| 674 | [hArg]Q[hArg]P[NMeArg][Cha]SHKG[Oic][Nle]P[4-Cl-F] | 0.00015215 | 0.000304 |
| 675 | Q[hArg]P[NMeArg][Cha]SHKG[Oic][Nle]P[4-Cl-F] | 0.00015933 | 0.000189 |
| 676 | OF[hArg][hArg]Q[hArg][Sar][hArg][Cha]SHKG[Oic][Nle]P[4-Cl-F] | 0.00076217 | 0.00084033 |
| 677 | OF[hArg][hArg]Q[hArg][Aib][hArg][Cha]SHKG[Oic][Nle]P[4-Cl-F] | 0.0035003 | 0.0034803 |
| 678 | OF[hArg][hArg]Q[hArg]P[hArg][Cha][Sar]HKG[Oic][Nle]P[4-Cl-F] | 0.000664 | 0.0021133 |
| 679 | OF[hArg][hArg]Q[hArg]P[hArg][Cha]S[NMeVal]KG[Oic][Nle]P[4-Cl-F] | 0.0036267 | 0.033 |

TABLE 11-continued

APJ Agonist Activity of Modified Apelin Polypeptides

| SEQ ID NO: | SEQUENCE | EC50Human APJ Receptor (μM) | EC50Rat APJ Receptor (μM) |
|---|---|---|---|
| 680 | OF[hArg][hArg]Q[hArg]P[hArg][Cha]SHK[Sar][Oic][Nle]P[4-Cl-F] | 0.0001161 | 0.00040067 |
| 681 | OF[hArg][hArg]Q[hArg]P[hArg][Cha]SHK[Aib][Oic][Nle]P[4-Cl-F] | 0.00072267 | 0.0013033 |
| 682 | OF[hArg][hArg]Q[hArg]P[hArg][Cha]SHKG[Aib][Nle]P[4-Cl-F] | 0.0015347 | 0.00798 |
| 683 | OF[hArg][hArg]Q[hArg]P[hArg][Cha]SHKG[Sar][Nle]P[4-Cl-F] | 0.00037867 | 0.000926 |
| 685 | OF[hArg][hArg]Q[hArg]P[hArg][Cha]SHKG[Oic][Nle][Aib][4-Cl-F] | 0.0000946 | 0.00016767 |
| 686 | O[BhPhe][hArg][hArg]Q[hArg]P[hArg][Cha]SHKG[Oic][Nle]P[4-Cl-F] | 0.00010907 | 0.00018767 |
| 687 | O[BPhe][hArg][hArg]Q[hArg]P[hArg][Cha]SHKG[Oic][Nle]P[4-Cl-F] | 0.0000918 | 0.00017533 |
| 689 | OF[hArg][BhArg]Q[hArg]P[hArg][Cha]SHKG[Oic][Nle]P[4-Cl-F] | 0.0001137 | 0.00034933 |
| 690 | OF[hArg][hArg][BhGln][hArg]P[hArg][Cha]SHKG[Oic][Nle]P[4-Cl-F] | 0.000111 | 0.00018333 |
| 691 | OF[hArg][hArg][BhAsn][hArg]P[hArg][Cha]SHKG[Oic][Nle]P[4-Cl-F] | 0.00045267 | 0.000424 |
| 692 | OF[hArg][hArg][BhLeu][hArg]P[hArg][Cha]SHKG[Oic][Nle]P[4-Cl-F] | 0.00048533 | 0.00050333 |
| 693 | OF[hArg][hArg]Q[BhArg]P[hArg][Cha]SHKG[Oic][Nle]P[4-Cl-F] | 0.00022933 | 0.00050467 |
| 694 | OF[hArg][hArg]Q[hArg][BhPro][hArg][Cha]SHKG[Oic][Nle]P[4-Cl-F] | 0.00045767 | 0.00060167 |
| 695 | OF[hArg][hArg]Q[hArg][Pip][hArg][Cha]SHKG[Oic][Nle]P[4-Cl-F] | 0.00031333 | 0.000384 |
| 696 | OF[hArg][hArg]Q[hArg]P[BhArg][Cha]SHKG[Oic][Nle]P[4-Cl-F] | 0.000261 | 0.00029967 |
| 697 | OF[hArg][hArg]Q[hArg]P[hArg][BhLeu]SHKG[Oic][Nle]P[4-Cl-F] | 0.000225 | 0.000495 |
| 698 | OF[hArg][hArg]Q[hArg]P[hArg][Cha][BhSer]HKG[Oic][Nle]P[4-Cl-F] | 0.00053867 | 0.00073367 |
| 699 | OF[hArg][hArg]Q[hArg]P[hArg][Cha][bAla]HKG[Oic][Nle]P[4-Cl-F] | 0.00044033 | 0.000603 |
| 700 | OF[hArg][hArg]Q[hArg]P[hArg][Cha]S[bAla]KG[Oic][Nle]P[4-Cl-F] | 0.00094933 | 0.0031133 |
| 701 | OF[hArg][hArg]Q[hArg]P[hArg][Cha]SH[BhLys]G[Oic][Nle]P[4-Cl-F] | 0.000316 | 0.00087933 |
| 702 | OF[hArg][hArg]Q[hArg]P[hArg][Cha]SH[BLys]G[Oic][Nle]P[4-Cl-F] | 0.00033 | 0.0014867 |
| 703 | OF[hArg][hArg]Q[hArg]P[hArg][Cha]SH[bAla]G[Oic][Nle]P[4-Cl-F] | 0.00126 | 0.0026667 |
| 704 | OF[hArg][hArg]Q[hArg]P[hArg][Cha]SHK[bAla][Oic][Nle]P[4-Cl-F] | 0.00096333 | 0.0028567 |
| 705 | OF[hArg][hArg]Q[hArg]P[hArg][Cha]SHKG[bAla][Nle]P[4-Cl-F] | 0.0034833 | 0.011063 |
| 706 | OF[hArg][hArg]Q[hArg]P[hArg][Cha]SHKG[BhPro][Nle]P[4-Cl-F] | 0.0019867 | 0.0043867 |
| 707 | OF[hArg][hArg]Q[hArg]P[hArg][Cha]SHKG[Pip][Nle]P[4-Cl-F] | 0.000294 | 0.00047133 |
| 708 | OF[hArg][hArg]Q[hArg]P[hArg][Cha]SHKG[Oic][bAla]P[4-Cl-F] | 0.00746 | 0.0234 |

TABLE 11-continued

APJ Agonist Activity of Modified Apelin Polypeptides

| SEQ ID NO: | SEQUENCE | EC50Human APJ Receptor (μM) | EC50Rat APJ Receptor (μM) |
|---|---|---|---|
| 709 | OF[hArg][hArg]Q[hArg]P[hArg][Cha]SHKG[Oic][Nle][BhPro][4-Cl-F] | 0.000555 | 0.00086167 |
| 710 | OF[hArg][hArg]Q[hArg]P[hArg][Cha]SHKG[Oic][Nle][bAla][4-Cl-F] | 0.000785 | 0.00179 |
| 711 | OF[hArg][hArg]Q[hArg]P[hArg][Cha]SHKG[Oic][Nle][Pip][4-Cl-F] | 0.00022867 | 0.000351 |
| 712 | OF[hArg][hArg]Q[hArg]P[hArg][Cha]SHKG[Oic][Nle][D-1Nal] | 0.00065433 | 0.000821 |
| 713 | OF[hArg][hArg]Q[hArg]P[hArg][Cha]SHKG[Oic][Nle][D-2Nal] | 0.00154 | 0.001137 |
| 714 | OF[hArg][hArg]Q[hArg]P[hArg][Cha]SHKG[Oic][Nle]P[4-Cl-F] | 0.0001682 | 0.00027138 |

Example 4. Apelin Polypeptides Improve Cardiac Function

To assess the hemodynamic cardiac function of the peptides, a Langendorff isolated heart system was used. The isolated heart from rat provides a broad spectrum of measurements that can include biochemical, metabolic, morphological and physiological indices. Although the system lacks neurohormonal influences, neural regulation and high coronary flows, the advantages of the system include the ability to study direct cardiac effects without systemic circulation and a host of peripheral interactions. This method can yield excellent dose-response relationships and provides critical insight into the pharmacological and physiological properties of the molecules of interest.

Animals were anesthetized through administration of 50-100 mg/kg dose of sodium pentobarbital via the intraperitoneal route. The heart was excised and gently cradled between fingers to avoid injury followed by lifting slightly before incising the aorta, vena cava and pulmonary vessels. Immediately after excision of the heart with aorta, the heart was mounted onto the cannula in the Langendorff apparatus via the aorta. The heart was perfused with modified oxygenated Krebs-Henseleit buffer at pH7.5 and equilibrated with 95% $O_2$/5% $CO_2$ at 37'C. The perfusion was performed at a constant flow of 10 ml/min and paced at 300 bpm. The pressure was measured through a pressure sensing balloon catheter inserted in the left ventricular cavity. The intrinsic inotropy (force of muscle contraction) and lusitropy (cardiac relaxation) effects of the heart were assessed by $dp/dt_{max}$ and $dp/dt_{min}$.

The following polypeptides were tested for effects on cardiac function in the Langendorff isolated heart system.

(SEQ ID NO: 16)
Acetyl-[hArg][r]Q[hArg]P[r][NMeLeu]SHKG[Oic]
[pI-Phe]P[D-Bip]{COOH}

(SEQ ID NO: 53)
Acetyl-Q[hArg]P[r][NMeLeu]SHKG[Oic][pI-Phe]
P[D-Bip]{COOH}

FIGS. 4A-D and 5A-D illustrate a dose-dependent improvement of both systolic and diastolic function in isolated perfused rat hearts with peptides of SEQ ID NO: 16 and SEQ ID NO: 53, respectively.

Example 5. Apelin Polypeptides Improve Cardiac Function in Rats with Heart Failure To assess the cardiovascular effects of modified apelin polypeptides, the polypeptides were administered to rats with myocardial infarction (MI)-induced heart failure. Cardiac function was assessed via the Millar PV loop system.

Male Lewis rats at 2-3 month of age were used for the studies. MI was induced by ligation of the left anterior descending coronary artery (LAD). Echocardiography was performed at 1 week post-MI for animal enrollment. If ejection fraction (EF) was more than 40% and no infarct was identified from echocardiography images, these animals were excluded from the study. A Millar PV loop catheter was inserted into the right common carotid artery and then advanced to the left ventricle (LV) for cardiovascular hemodynamic assessment. The arterial pressure catheter was inserted into a femoral artery for peripheral blood pressure monitoring. Experiments were performed six to seven weeks following induction of MI. The following apelin polypeptides were given intravenously via jugular vein at various doses.

Pyr-Apelin:
(SEQ ID NO: 6)
{Hydrogen}[PE]RPRLSHKGPMPF{COOH}

(SEQ ID NO: 109)
{Acetyl-NH}[NPeg11]QRP[hArg][Cha]SHKG[Oic]
[Nle]P[4-Cl-F]{COOH}

(SEQ ID NO: 16)
Acetyl-[hArg][r]Q[hArg]P[r][NMeLeu]SHKG[Oic]
[pI-Phe]P[D-Bip]{COOH}

Peptides were continuously infused for 30 min at each dose. At the end of the experiment, the infarct size was verified by gross morphology. FIGS. 6-8 show the results of these experiments. The infarct size (38-39% of LV) was very similar among groups. The results demonstrate the dose-dependent effects of pyr-Apelin-13 (SEQ ID NO. 6; FIG. 6A-D) and modified analogues (SEQ ID NOs. 109 and 16;

FIGS. 7A-D and 8A-D, respectively) on hemodynamic function in MI rats following continuous infusion. Contractility (dp/dt max), ejection fraction (EF), mean arterial pressure (MAP), and heart rate (HR) changes over baseline are reported at the end of the 30 min infusion period for each polypeptide.

Example 6. Pharmacokinetic Profile of Modified Apelin Polypeptides

Figure 9:
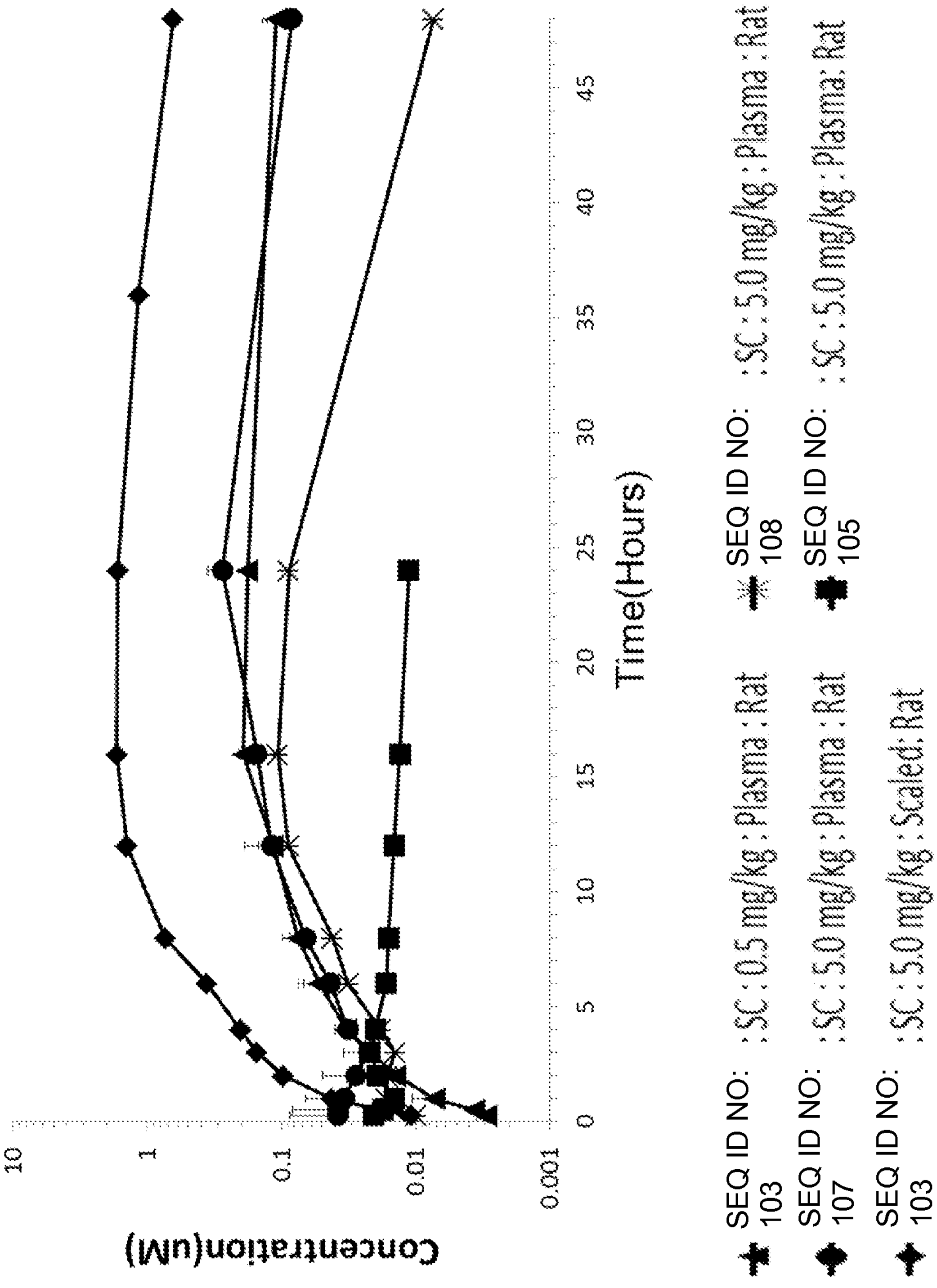
FIG. 9 shows the in vivo pharmacokinetics of four different 20 kDa PEGylated apelin peptides (SEQ ID NOs: 103, 105, 107, and 108) in rat. A plot of concentration of peptide in rat plasma versus time is shown. Data for a dose of 5 mg/kg for SEQ ID NO: 103 (diamonds) was simulated based on predictive scaling to highlight the increased exposure resulting from the improved metabolic stability for this polypeptide.
Figure 10A:
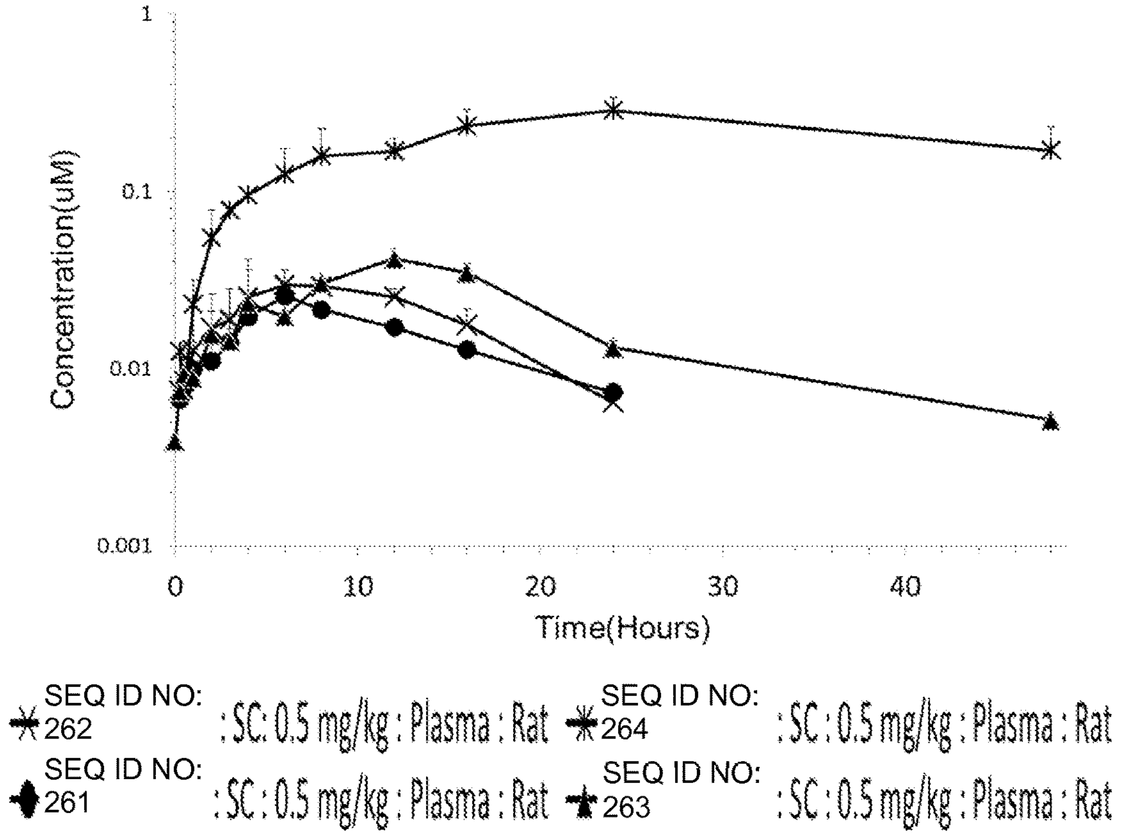
FIGS. 10A-10B show the in vivo pharmacokinetics for various lipidated apelin peptides in rat.
Figure 10B:
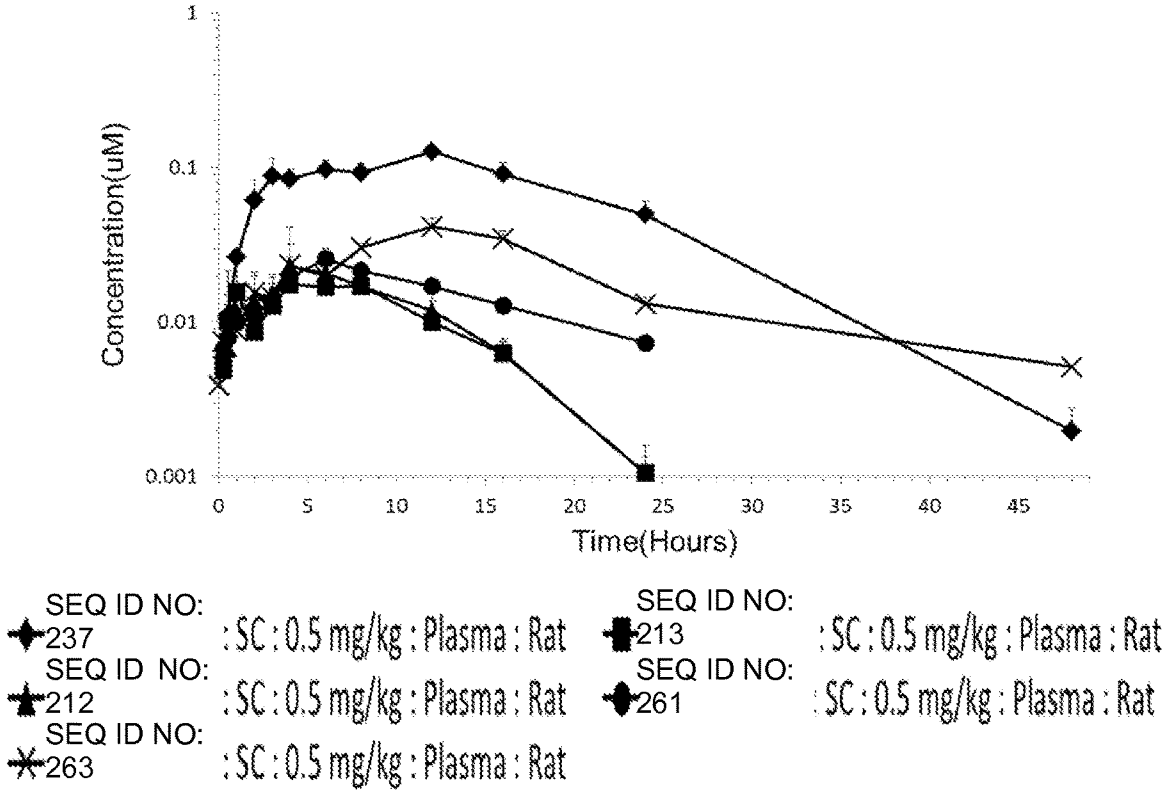

Evaluation of the in vivo pharmacokinetic profile of several pegylated and lipidated apelin polypeptides in rat was undertaken (FIGS. 9 and 10A-B). The apelin polypeptides were administered to Sprague-Dawley rats through subcutaneous (SC) administration and the pharmacokinetic profile for each polypeptide was subsequently evaluated. A PBS buffer solution containing the apelin peptide was administered to rats via jugular vein to a final dose of 0.5 mg/kg or 5 mg/kg. Blood samples collected over a 24 hr period were transferred into collection tubes containing potassium EDTA and stored on ice until processed. Plasma was obtained from blood by centrifugation. After transfer into a 96-well container, plasma samples were stored in a freezer maintained at approximately −80° C. Quantitative analysis of the apelin polypeptide in rat plasma samples was achieved using multiple reaction monitor (MRM) mode on a LC-MS/MS system.

In vivo pharmacokinetics of a series of 20 kDa PEGylated peptides was investigated in Sprague-Dawley rats. The sequence of the apelin polypeptide was varied between the peptides tested, whereas the PEG polymer (20 kDa PEG) was constant. Plasma concentration/exposure can be modulated by intrinsic metabolic stability of the peptide. As shown in FIG. 9, high plasma concentrations were achieved with peptide SEQ ID NO: 103 at 1/10" the dose of other 20 kDa PEGylated apelin peptides.

The sequences of the pegylated apelin polypeptides used in the pharmacokinetic study are listed below:

(SEQ ID NO: 105)
{Acetyl}[Atz(20-mPEG)]KFRRQRP[hArg][Cha]SHKG[Oic][Nle]P[4-Cl-F]{COOH}

(SEQ ID NO: 107)
{Acetyl-NH}[Pra](20K-mPEG Reg)OF[hArg][hArg]QRP[hArg][NMeLeu]SHKG [Oic][pI-Phe]P[D-Bip]{COOH}

(SEQ ID NO: 108)
{Acetyl-NH}[Pra](20K-mPEG Reg)OF[hArg][hArg]QRP[hArg][NMeLeu]SHKG [Oic][pI-Phe]P[pI-Phe]{COOH}

(SEQ ID NO: 103)
{H2}[3TP](20K-mPEG Reg)[hArg]rQ[hArg]Pr[NMeLeu]SHKG[Oic][pI-Phe]P[D-Bip]{COOH}

In vivo pharmacokinetics of a series of lipidated peptides in Sprague-Dawley rats was investigated. In the first set of experiments, the fatty acyl groups (Tridecanoyl, Pentadeconyl, Heptadeconyl, and Octadecandioyl) were varied between the peptides tested, whereas the peptide sequence remained the same. As shown in FIG. 10A, plasma concentration/exposure can be modulated with length & composition of the fatty acyl group. The structure for each of the peptides that were used in this first set of experiments is depicted below:

(SEQ ID NO: 261)
{TDA}[AC4Abu][Aeea][Aeea][hArg]rQ[hArg]Pr[NMeLeu]SHKG[Oic][pI-Phe]P[D-Bip]{COOH}

(SEQ ID NO: 262)
{PDA}[AC4Abu][Aeea][Aeea][hArg]rQ[hArg]Pr[NMeLeu]SHKG[Oic][pI-Phe]P[D-Bip]{COOH}

(SEQ ID NO: 263)
{HDA}[AC4Abu][Aeea][Aeea][hArg]rQ[hArg]Pr[NMeLeu]SHKG[Oic][pI-Phe]P[D-Bip]{COOH}

(SEQ ID NO: 264)
{ODDA}[AC4Abu][Aeea][Aeea][hArg]rQ[hArg]Pr[NMeLeu]SHKG[Oic][pI-Phe]P[D-Bip]{COOH}

In the second set of experiments, the sequence of the apelin peptide was varied in polypeptide SEQ ID NOs: 237, 213, 212 and 261, whereas the fatty acyl groups differ between polypeptide SEQ ID NOs: 237 and 263 and polypeptide SEQ ID NOs: 212, 213, and 261. As shown in FIG. 10B, plasma concentration/exposure can be modulated by intrinsic metabolic stability of the peptide as well as the fatty acyl group.

The structure for each of the peptides that were used in this second set of experiments is depicted below:

(SEQ ID NO: 237)
{HDA}[AC4Abu][Aeea][Aeea][q][hArg]P[NMeArg][Cha]SHKG[Oic][Nle]P[D-4ClF]{COOH}

(SEQ ID NO: 263)
{HDA}[AC4Abu][Aeea][Aeea][hArg]rQ[hArg]Pr[NMeLeu]SHKG[Oic][pI-Phe]P[D-Bip]{COOH}

(SEQ ID NO: 212)
{TDA}[AC4Abu][Aeea][Acea]RQRP[hArg][NMeLeu]SHKG[Oic][pI-Phe]P[D-Bip]{COOH}

(SEQ ID NO: 261)
{TDA}[AC4Abu][Aeea][Aeea][hArg]rQ[hArg]Pr[NMeLeu]SHKG[Oic][pI-Phe]P[D-Bip]{COOH}

(SEQ ID NO: 213)
{TDA}[AC4Abu][Aeea][Aeea][r]QRP[hArg][NMeLeu]SHKG[Oic][pI-Phe]P[D-Bip]{COOH}

Example 7. Effect of Modified Apelin Polypeptides on Mast Cell Degranulation

Mast cell degranulation was measured for a number of the modified apelin polypeptides as follows in order to determine the potential immunogenic effect of the peptides. Mast cell degranulating peptide (MCDP) and compound 48/80 were used as positive controls. MCDP was obtained from Alomone Labs (Israel). Compound 48/80 was obtained from Sigma (Saint Louis, MI). Histamine Elisa kit was obtained from NEOGEN (Lexington, KY). Tyrode's buffer was obtained from Sigma (#T2397).

Rat Peritoneal Mast Cells

Rat peritoneal fluid was collected in Tyrode's buffer from 8 week old female Sprague Dawley or Lewis rats (Gillespie et al., Histamine release from rat peritoneal mast cells: inhibition by colchicine and potentiation, 1968; 154-1). Percentage of peritoneal mast cells (5-8%) was determined by Flow Cytometry and immunohistochemistry (IHC).

Human Mast Cells

Mature human mast cells were derived from CD34+ peripheral blood precursor cells after an 8-12 week differentiation/maturation process in vitro. CD34+ peripheral blood cells were obtained from AllCells (#MPB016F, donor ID #: PCA1452A) and cultured in the following media for 8-12 weeks: SFEM11 Stem Span serum-free media (#09655 StemCell Technologies), 1× Penicillin (100 U/ml) and streptomycin (100 ug/ml) (#15140-122, Life Technologies), 1×Gentamicin/Amphotericin B (Gibco #50-0640), 100 ng/ml SCF (#300-07, PeproTech), IL-3 for first week only (5 ng/ml, #203-IL-050, R&D Systems), IL-9 during week 1-3 (15 ng/ml, #209-IL-050, R&D Systems), IL-6 during week 5-onwards (50 ng/ml, #206-IL-050, R&D Systems) and IL-4 during week 8-onwards (10 ng/ml, #204-IL-050, R&D Systems). Mast cell maturation was confirmed via expression of the mast cell markers c-kit and FcεRI via flow cytometry (>75% positive) and histamine release.

Measurement of Mast Cell Degranulation

Mast cells (human or rat) were washed in Tyrode's buffer and seeded on 96-well plates (approx. 2000 mast cells/well). A 10 point dilution of test compounds were prepared in Tyrode's buffer and were incubated (0.005 to 30 μM) with mast cells at 37° C. for 30 min. When testing lipidated molecules, surfactants such as 0.1% Tween 80 from Croda (Edison, NJ) may be included in Tyrode's buffer to maintain lipidated molecule solubility in the assay. A mast cell surfactant control is compared to a mast cell Tyrode's buffer control to ensure surfactants are not inducing histamine release in the absence of the lipidated molecule. Histamine release was quenched by placing the plates on ice for 5 min. Cells were centrifuged at 350×g at 4° C. for 5 min and the supernatant was collected. Released histamine was quantified by ELISA (Neogen Corporation) as per the kits' instruction. Briefly, the absorbance was measured at 650 nm in a microplate reader, following a direct competitive ELISA reaction with test samples compared against a standard curve. Total histamine content of the cells (0.1% Triton X-100) and spontaneous release were also measured to determine the percent of histamine release. Percent histamine release was calculated by the following formula:

% histamine release=(ng/ml histamine release by test article−ng/ml spontaneous histamine release in Tyrode's buffer)/(ng/ml total histamine content of cells lysed in 0.1% Triton X-100−ng/ml spontaneous histamine release in Tyrode's buffer)×100.

Table 12 below summarizes the results of the rat mast cell degranulation assay for several modified apelin polypeptides.

TABLE 12

Activity of Apelin Peptides in Inducting Histamine Release from Rat Mast Cells

| Apelin Polypeptide SEQ ID NO. | Cause Histamine Release? | $EC_{50}$ (μM) |
|---|---|---|
| MCDP | Yes | 0.52 |
| 50 | Yes | 0.52 |
| 51 | Yes | 0.54 |
| 52 | Yes | 0.55 |
| 213 | Yes | 2.74 |
| 242 | Yes | 3.24 |
| 212 | Yes | 4.24 |
| 55 | Yes | 8.17 |
| 54 | Yes | 9.84 |
| 237 | No | * |
| Pyr-Apelin-13; 6 | No | * |

Synthetically modified apelin polypeptides have a range of potencies in inducing in vitro histamine release. SEQ ID NOs: 50-52 are as potent as the positive control, MCDP, whereas SEQ ID NOs: 237 and 6 (pyr-Apelin-13) are inactive at the highest concentrations tested. It can be observed from the table that the polypeptide of SEQ ID No. 237 does not induce histamine release in the assay.

Example 8. Modified Apelin Polypeptides with Reduced Mast Cell Degranulation Capabilities As shown in Example 7, some modified apelin polypeptides induce histamine release from rat mast cells, suggesting that these polypeptides may have a potential immunogenic effect. To more fully understand the relationship between the structure of the modified polypeptides and the induction of degranulation, and to generate additional polypeptides with reduced degranulation capability, a further structure-activity relationship (SAR) study was conducted. The modified apelin polypeptides in Table 13 below were tested for induction of histamine release from rat and human mast cells using the methods described in Example 7. Compounds that induced less than 30% of the total detected histamine content of the cells were deemed to be negative in the assay.

TABLE 13

Mast Cell Degranulation Activity of Modified Apelin Polypeptides

| Apelin Poly- peptide SEQ ID NO: | Sequence | Induce Histamine Release? Rat Mast Cells | Human Mast Cells |
|---|---|---|---|
| 71 | {Acetyl-NH} Q [hArg] P [NMeArg] [aMeLeu] S H K G P [Nle] P [4-Cl-F] {COOH} | No | |
| 61 | {Acetyl-NH} Q [hArg] P [NMeArg] [Cha] S H K G [Oic] [Nle] P [4-Cl-F] {COOH} | No | |
| 69 | {Acetyl-NH} Q R [aMePro] [hArg] [aMeLeu] S H K G P [Nle] P [4-Cl-F] {COOH} | No | No |
| 70 | {Acetyl-NH} Q r P [hArg] [aMeLeu] S H K G P [Nle] P [4-Cl-F] {COOH} | No | |
| 92 | {Acetyl-NH} Q R P [NMeArg] [Cha] SH KG [Oic] [Nle] [Aib] [4-Cl-F] {COOH} | Yes | |
| 68 | {Acetyl-NH} Q R P [NMeArg] L S H K G P [Nle] P 4-Cl-F] {COOH} | No | No |
| 66 | {Acetyl-NH} R Q R P [NMeArg] [Cha] S H K G P [Nle] P [4-Cl-F] {COOH} | No | |
| 67 | {Acetyl-NH} R Q R P [NMeArg] [NMeLeu] S H K GP [Nle] P [4-Cl-F] {COOH} | No | |
| 65 | {Acetyl-NH} R Q R P [NMeArg] L S H K G P [Nle] P [4-Cl-F] {COOH} | No | |
| 63 | {Acetyl-NH} R Q R P R [Cha] S H K G P [Nle] P 4-Cl-F] {COOH} | No | |
| 64 | {Acetyl-NH} R Q R P R [NMeLeu] S H K GP [Nle] P [4-Cl-F] {COOH} | No | |
| 62 | {Acetyl-NH} R Q R P R L S H K G P [Nle] P [D-Bip] {COOH} | Yes | |
| 60 | {Acetyl-NH} [hArg]Q[hArg]P[NMeArg][Cha] S H K G [Oic] [Nle] P [4-Cl-F] {COOH} | Yes | |
| 491 | {Butanoyl} [AC4Abu] [Aeea] [Aeea] Q R P [NMeArg] L S H K G P [Nle] P [4-Cl-F] {COOH} | No | No |
| 116 | {H2} [MerPr] (10K mPEG acetamide) Q [NMehArg] P [NMeArg] [aMeLeu] S H K GP [Nle] P [4-Cl-F] {COOH} | No | |
| 114 | {H2} [MerPr] (10K mPEG acetamide) Q R [aMePro] [hArg] [aMeLeu] S H K G P [Nle] P [4-CI-F] {COOH} | No | No |
| 119 | {H2} [MerPr] (10K mPEG acetamide) Q r P [hArg] [aMeLeu] S H K GP [Nle] P [4-Cl-F] {COOH} | No | |
| 120 | {H2} [MerPr] (10K mPEG acetamide) Q R P [NMeArg] [Cha] S H K G [Oic] [Nle] [Aib] [4-Cl-F] {COOH} | No | |
| 110 | {H2} [MerPr] (10K mPEG acetamide) Q R P R L S H K G P M P F {COOH} | No | |
| 13 | {H2} C M P L H S R V P F P {COOH} | No | |
| 12 | {H2} K F R R Q R P R L S H K G P M P {COOH} | Yes | |
| 496 | {HDA} [AC4Abu] [Aeea] [Aeea] Q R P [NMeArg] LSHK GP [Nle] P [4-Cl-F] {COOH} | Yes | |
| 286 | {hexanoyl} [AC4Abu] [Aeea] [Aeea] [hArg] r Q [hArg] P r [NMeLeu] S H K G [Oic] [pI-Phe] P [D-Bip] {COOH} | Yes | |

TABLE 13-continued

Mast Cell Degranulation Activity of Modified Apelin Polypeptides

| Apelin Poly-peptide SEQ ID NO: | Sequence | Induce Histamine Release? Rat Mast Cells | Human Mast Cells |
|---|---|---|---|
| 290 | {ODDA} [AC4Abu] [Aeea] [Aeea] Q R P R L S H K G P M P F {COOH} | Yes | |
| 577 | {Palm} [AC4Abu] [Aeea] [Aeea] q R P [NMeArg] [Cha] S H K G [Oic] [Nle] [Aib] [BhPhe] {COOH} | Yes | |
| 578 | {Palm} [AC4Abu] [Aeea] [Aeea] q R P [NMeArg] [Cha] S H K G [Oic] [Nle] [BhPhe] {COOH} | Yes | |
| 600 | {Palm} [AC4Abu] [Aeea] [Aeea] q R P [NMeArg] [Cha] S H K G [Oic] [Nle] [BhPro] [D-4CIF] {COOH} | Yes | |
| 604 | {Palm} [AC4Abu] [Aeea] [Aeea] q R P [NMeArg] [Cha] S H K G [Oic] [Nle] [Aib] [D-4CIF] {COOH} | Yes | |
| 588 | {Palm} [AC4Abu] [Aeea] [Aeea] q R P [NMeArg] [Cha] S H K G [Pip] [Nle] [Nip] [4-Cl-F] {COOH} | Yes | |
| 597 | {Palm} [AC4Abu] [Aeea] [Aeea] q R P [NMeArg] [Cha] S H K G [Pip] [Nle] [Aic] {COOH} | Yes | |
| 598 | {Palm} [AC4Abu] [Aeea] [Aeea] q R P [NMeArg] Cha] S H K G [Pip] [Nle] P [Tic] {COOH} | Yes | |
| 599 | {Palm} [AC4Abu] [Aeea] [Aeea] q R P [NMeArg] [Cha] S H K G [Pip] [Nle] P [D-Tic] {COOH} | Yes | |
| 495 | {PDA} [AC4Abu] [Aeea] [Aeea] Q R P [NMeArg] L SHK GP [Nle] P [4-Cl-F] {COOH} | Yes | |
| 289 | {Sebacicacid} [AC4Abu] [Aeea] [Aeea] [hArg] r Q [hArg] Pr [NMeLeu] S H K G [Oic] [pI-Phe] P [D-Bip] {COOH} | Yes | |
| 594 | {St} [AC4Abu] [Acea] [Acea] Q R P [NMeArg] L S HK GP [Nle] P [4-Cl-F] {COOH} | Yes | |
| 490 | {TDA} [AC4Abu] [Aeea] [Aeea] [hArg] Q [hArg] P [hArg] [Cha] S H K G [Oic] [Nle] P [4-Cl-F] {COOH} | Yes | |
| 297 | {TDA} [AC4Abu] [Aeea] [Aeea] O F [hArg] [hArg] Q [NMeArg] P [NMeArg] [Cha] S H K G [Oic] [Nle] P [4-Cl-F] {COOH} | Yes | |
| 488 | {TDA} [AC4Abu] [Aeea] [Aeea] q [hArg] P [hArg] [Cha] S H K G [Oic] [Nle] P [4-Cl-F] {COOH} | Yes | |
| 362 | {TDA} [AC4Abu] [Aeea] [Aeea] Q [hArg] P [NMeArg] [Cha] S H K G [Oic] [Nle] P [4-Cl-F] {COOH} | Yes | |
| 483 | {TDA} [AC4Abu] [Aeea] [Aeea] Q [hArg] P INMehArg] L S H K GP [Nle] P [4-Cl-F] {COOH} | Yes | |
| 363 | {TDA} [AC4Abu] [Aeea] [Aeea] q [hArg] P r [Cha] SH KG [Oic] [Nle] P [4-Cl-F] {COOH} | Yes | |
| 482 | {TDA} [AC4Abu] [Acea] [Aeea] Q R [aMePro] [hArg] [aMeLeu] S H K G P [Nle] P [4-Cl-F] {COOH} | Yes | |
| 502 | {TDA} [AC4Abu] [Aeea] [Acea] q R [aMePro] [hArg] [BLeu] S H K G [Oic] [Nle] [aMePro] [4-Cl-F] {COOH} | Yes | |

TABLE 13-continued

Mast Cell Degranulation Activity of Modified Apelin Polypeptides

| Apelin Poly-peptide SEQ ID NO: | Sequence | Induce Histamine Release? Rat Mast Cells | Induce Histamine Release? Human Mast Cells |
|---|---|---|---|
| 522 | {TDA} [AC4Abu] [Aeea] [Aeea] q R [BhPro] [hArg] [BLeu] S H K G [Oic] [Nle] [Aib] [4-Cl-F] {COOH} | Yes | |
| 516 | {TDA} [AC4Abu] [Acea] [Aeea] q R [BhPro] [NMeArg] [Cha] S H K G [Oic] [Nle] [Aib] [4-Cl-F] {COOH} | Yes | |
| 517 | {TDA} [AC4Abu] [Aeea] [Aeea] q R [Pip] [NMeArg] [Cha] S H K G [Oic] [Nle] [Aib] [4-Cl-F] {COOH} | Yes | |
| 554 | {TDA} [AC4Abu] [Aeea] [Aeea] q R P [NMeArg] [aMeLeu] S H K G [Oic] [Nle] [BhPro] [4-Cl-F] {COOH} | Yes | |
| 500 | {TDA} [AC4Abu] [Aeea] [Aeea] q R P [NMeArg] [Cha] [BhSer] H K G [Oic] [Nle] [Aib] [4-Cl-F] {COOH} | Yes | |
| 418 | {TDA} [AC4Abu] [Aeea] [Acea] Q R P [NMeArg] [Cha] S H K G [aMePro] [Nle] P [4-Cl-F] {COOH} | Yes | |
| 551 | {TDA} [AC4Abu] [Aeea] [Acea] q R P [NMeArg] [Cha] S H K G [aMePro] [Nle] [4-Cl-F] {COOH} | No | |
| 382 | {TDA} [AC4Abu] [Aeea] [Aeea] Q R P [NMeArg] [Cha] S H K G [Oic] [Nle] [Aib] [4-Cl-F] {COOH} | Yes | |
| 412 | {TDA} [AC4Abu] [Aeea] [Aeea] Q R P [NMeArg] [Cha] S H K G [Oic] [Nle] [aMePro] [4-Cl-F] {COOH} | Yes | |
| 352 | {TDA} [AC4Abu] [Aeea] [Aeea] Q R P [NMeArg] L S H K G [Oic] [Nle] P [4-Cl-F] {COOH} | Yes | |
| 287 | {TDA} [AC4Abu] [Aeea] [Aeea] Q R P [NMeArg] L S H K G P [Nle] P [4-Cl-F] {COOH} | Yes | Yes |
| 526 | {TDA} [AC4Abu] [Aeea] [Aeea] q R P E [Cha] S H K G [Oic] [Nle] [Aib] [4-Cl-F] {COOH} | No | |
| 477 | {TDA} [AC4Abu] [Aeea] [Aeea] Q R P E L S H K G P [Nle] P [4-Cl-F] {COOH} | No | |

Mast cell degranulation is proposed to occur in part by a non-immunological mechanism (Watt, A. P. Immunopharmacology, 2002, 9, 421-434) related to the physical properties of peptide degranulators. For the modified apelin polypeptides, mast cell degranulation could be reduced by lowering a compound's lipophilicity and formal charge. For instance, acidic residues could be substituted at amino acid positions corresponding to positions 63, 64, 66 and 68 in the apelin preprotein (SEQ ID NO: 2) as in modified polypeptides set forth in SEQ ID NOs: 75-77, 477, and 526. Aliphatic residues (e.g. Nle) at the amino acid corresponding to position 75 in SEQ ID NO: 2 and small aromatic residues (e.g. 4-Cl-F) at the amino acid corresponding to position 77 in SEQ ID NO: 2 were preferred. Pegylation or Fc protein conjugation (see Example 11) at the N-terminus of the apelin polypeptide reduced mast cell degranulation as compared to the apelin polypeptide itself. For example, apelin polypeptide of SEQ ID NO: 92 was positive for inducing histamine release from rat mast cells. See Table 13. However, if this same peptide was pegylated (polypeptide of SEQ ID NO: 120) or conjugated to an immunoglobulin Fc domain (immunoglobulin 4 in Example 11), the peptide no longer induced histamine release from rat mast cells. N-terminal acetylation was fairly well tolerated. In general, lipidated peptides had increased lipophilicity and so tended to be more potent mast cell degranulators. By further reducing the formal charge (~<1), degranulation could be avoided for lipidated peptides as well. Shorter, less lipophilic lipids had less mast cell degranulation activity as illustrated for apelin polypeptide of SEQ ID NO: 491.

Example 9. Modified Apelin Polypeptides with Improved Stability

Evaluation of in vitro plasma, liver, and kidney stability of several modified apelin peptides was performed.

Apelin peptides were spiked into rat plasma, liver homogenate, and kidney homogenate, which were obtained from commercial sources, to a final concentration of 5 μM. The samples were then incubated at 37° C. over a period of 4 hr. Up to 8 time points were sampled to facilitate estimation of in vitro half-life in the three different matrices. In a typical experiment, an aliquot of 100 μL of sample was taken from the incubation vial, followed by addition of 300 μL of MeOH containing internal standard. The quenched sample was centrifuged at 5500 g for 15 min after 15 min vortex in room temperature. The supernatant was then analyzed by high resolution LC-MS. Accurate mass full scan mass data was used for estimation of parent peptide level over the time course of 4 hr, and the data was subsequently used for estimation of in vitro half-life in plasma, liver, and kidney. In vitro plasma, rat, and kidney stability results are shown below in Table 14.

TABLE 14

Stability of Modified Apelin Polypeptides in Rat Plasma, Liver, and Kidney

| SEQ ID NO: | Sequence | Stability at 4 hours (% Remaining) Plasma | Liver | Kidney |
|---|---|---|---|---|
| 6 | Pyr-apelin; {Hydrogen}[PE]RPRLSHKGPMPF{COOH} | <1.0 | <1.0 | <1.0 |
| 212 | {TDA}[AC4Abu][Aeea][Aeea]RQRP[hArg][NMeLeu] SHKG[Oic][pI-Phe]P[D-Bip]{COOH} | 39.5 | >90.0 | >90.0 |
| 263 | {HDA}[AC4Abu][Aeea][Aeea][hArg]rQ[hArg]Pr [NMeLeu]SHKG[Oic][pI-Phe]P [D-Bip]{COOH} | 79.3 | 67.6 | 82.6 |
| 237 | {HDA}[AC4Abu][Aeea][Aeea][q][hArg]P[NMeArg] [Cha]SHKG[Oic][Nle]P[D-4CIF]{COOH} | 85.2 | 65.8 | 35.3 |
| 16 | Acetyl-[hArg][r]Q[hArg]P[r][NMeLeu]SHKG[Oic] [pI-Phe]P[D-Bip]{COOH} | 86.1 | 40.7 | 44.5 |
| 262 | {PDA}[AC4Abu][Aeea][Aeea][hArg]rQ[hArg]Pr [NMeLeu]SHKG[Oic][pI-Phe ]P[D-Bip]{COOH} | >90.0 | 66 | 84.4 |
| 261 | {TDA}[AC4Abu][Aeea][Aeea][hArg]rQ[hArg]Pr [NMeLeu]SHKG[Oic][pI-Phe]P [D-Bip]{COOH} | >90.0 | No Result Obtained | 85.8 |
| 76 | {Acetyl-NH}[hArg] E Q [hArg]P r [NMeLeu] S H K G [Oic][p]-Phe]P [D-Bip] {COOH} | >90.0 | 26.7 | 34 |
| 60 | {Acetyl-NH}[hArg] Q [hArg] P [NMeArg] [Cha]S H K G [Oic][Nle]P [4-Cl-F] {COOH} | 21.8 | <1.0 | 0.68 |
| 79 | {Acetyl-NH}[hArg] r Q [hArg]PE [NMeLeu]S H K G [Oic][pI-Phe]P [D-Bip] {COOH} | >90.0 | <1.0 | 1.3 |
| 75 | {Acetyl-NH} E r Q [hArg]P r [NMeLeu] S H K G [Oic][pI-Phe] P [D-Bip] {COOH} | >90.0 | 19.5 | 39.9 |
| 71 | {Acetyl-NH} Q [hArg ]P [NMeArg][aMeLeu] S H K G P [Nle] P [4-Cl-F]{COOH} | 0 | 35.5 | 0.1 |
| 61 | {Acetyl-NH} Q [hArg] P [NMeArg][Cha] S H K G [Oic][Nle]P [4-Cl-F]{COOH} | 27.91 | <1.0 | 7.575 |
| 69 | {Acetyl-NH} Q R [aMePro][hArg] [aMeLeu] S H K G P [Nle] P [4-Cl-F]{COOH} | <1.0 | No Result Obtained | <1.0 |
| 70 | {Acetyl-NH} Q r P [hArg][aMeLeu] S H K G P [Nle]P [4-Cl-F]{COOH} | 86.1 | 84.9 | No Result Obtained |
| 92 | {Acetyl-NH} Q R P [NMeArg][Cha] S H K G [Oic][Nle][Aib][4-Cl-F]{COOH} | 48 | <1.0 | <1.0 |
| 68 | {Acetyl-NH} Q R P [NMeArg] L S H K G P [Nle]P [4-Cl-F]{COOH} | 59.6 | <1.0 | <1.0 |
| 66 | {Acetyl-NH}R Q R P [NMeArg][Cha]S H K G P [Nle]P [4-Cl-F]{COOH} | 2.4 | Not tested | Not tested |

TABLE 14-continued

| Stability of Modified Apelin Polypeptides in Rat Plasma, Liver, and Kidney | | | | |
|---|---|---|---|---|
| SEQ ID NO: | Sequence | Stability at 4 hours (% Remaining) Plasma | Liver | Kidney |
| 62 | {Acetyl-NH}R Q R P R L S H K G P [Nle] P [D-Bip]{COOH} | 6.3 | <1.0 | <1.0 |
| 515 | {AdpA}[AC4Abu][Aeea][Aeea] Q r P [hArg][aMeLeu]S H K G P [Nle]P [4-Cl-F]{COOH} | 2 | <1.0 | 6 |
| 491 | {Butanoyl}[AC4Abu][Aeea][Aeea] Q R P [NMeArg]L S H K G P [Nle]P [4-Cl-F]{COOH} | <1.0 | <1.0 | <1.0 |
| 113 | {H2}[MerPr](10K mPEG acetamide) Q [hArg]P [NMehArg]L S H K G P [Nle]P [4-Cl-F]{COOH} | 49 | 64 | 17 |
| 114 | {H2}[MerPr](10K mPEG acetamide) Q R [aMePro][hArg][aMeLeu]S H K G P [Nle]P [4-Cl-F]{COOH} | 58 | >90.0 | >90.0 |
| 119 | {H2}[MerPr](10K mPEG acetamide) Q r P [hArg][aMeLeu]S H K G P [Nle]P [4-Cl-F]{COOH} | 44 | >90.0 | 89 |
| 120 | {H2}[MerPr](10K mPEG acetamide) Q R P [NMeArg][Cha]S H K G [Oic][Nle][Aib][4-Cl-F]{COOH} | 68 | 61 | <1.0 |
| 116 | {H2}[MerPr](10K mPEG acetamide) Q [NMehArg]P [NMeArg][aMeLeu]S H K G P [Nle]P [4-Cl-F]{COOH} | 48 | >90.0 | 88 |
| 110 | {H2}[MerPr](10K mPEG acetamide) Q R P R L S H K G P M P F {COOH} | 36 | 61 | 27 |
| 13 | {H2}C M P L H S R V P F P {COOH} | 7 | <1.0 | <1.0 |
| 14 | {H2}K L R K H N [Abu] L Q R R [Abu]M P L H S R V P F P {COOH} | <1.0 | <1.0 | No Result Obtained |
| 15 | {H2}K L R K H N C L Q R R C M P L H S R V P F P {COOH} | 17 | <1.0 | 0 |
| 496 | {HDA}[AC4Abu][Acea][Aeea] Q R P [NMeArg]L S H K G P [Nle] P [4-Cl-F]{COOH} | 86 | 3 | <1.0 |
| 561 | {hexanoyl}[AC4Abu][Aeea][Aeea] Q [NMehArg]P [NMeArg][aMeLeu]S H K G P [Nle]P [4-Cl-F]{COOH} | <1.0 | <1.0 | <1.0 |
| 562 | {hexanoyl}[AC4Abu][Aeea][Aeea] Q R P [NMeArg][Cha] S H K G [Oic][Nle]Aib][4-Cl-F]{COOH} | >90.0 | 4 | <1.0 |
| 614 | {Palm}[AC4Abu][Aeea][Aeea] q [hArg] P r [Cha]S H K G [Oic][Nle]P [D-BhPhe]{COOH} | 90 | 11 | 9 |
| 569 | {Palm}[AC4Abu][Aeea][Aeea] q R P [NMeArg][Cha]S H K G [Oic][Nle][Aib][D-BhPhe]{COOH} | >90.0 | 34 | 14 |
| 570 | {Palm}[AC4Abu][Aeea][Aeea] q R P [NMeArg][Cha]S H K G [Oic][Nle]aMePro][D-BhPhe]{COOH} | >90.0 | 32 | 11 |
| 571 | {Palm}[AC4Abu][Aeea][Aeea] q R P [NMeArg][Cha] S H K G [Oic][Nle][BhPro][D-BhPhe]{COOH} | >90.0 | 35.5 | 16 |

TABLE 14-continued

| Stability of Modified Apelin Polypeptides in Rat Plasma, Liver, and Kidney | | | | |
|---|---|---|---|---|
| SEQ ID NO: | Sequence | Stability at 4 hours (% Remaining) Plasma | Liver | Kidney |
| 572 | {Palm}[AC4Abu][Aeea][Aeea] q R P [NMeArg] [Cha] S H K G [Oic][Nle] [bAla][D-BhPhe]{COOH} | 89 | 37.5 | 14.5 |
| 573 | {Palm}[AC4Abu][Aeea][Aeea] q R P [NMeArg] [Cha] S H K G [Oic][Nle][D-BhPhe]{COOH} | 79 | 59 | 27 |
| 584 | {Palm}[AC4Abu][Aeea][Aeea] q R P [NMeArg] [Cha] S H K G [Oic][Nle][1-Ach][4-Cl-F]{COOH} | 62 | 77 | 6 |
| 585 | {Palm}[AC4Abu][Aeea][Aeea] q R P [NMeArg] [Cha] S H K G [Oic][Nle][Acp] [4-Cl-F]{COOH} | 70 | 65 | 5 |
| 587 | {Palm}[AC4Abu][Aeea][Aeea] q R P [NMeArg] [Cha] S H K G [Oic][Nle][Inp] [4-Cl-F]{COOH} | >90.0 | 64 | 34 |
| 588 | {Palm}[AC4Abu][Aeea][Aeea] q R P [NMeArg] [Cha] S H K G [Pip][Nle][Nip][4-Cl-F]{COOH} | >90.0 | No Result Obtained | No Result Obtained |
| 590 | {Palm}[AC4Abu][Aeea][Aeea] q R P [NMeArg] [Cha]S H K G [Pip][Nle]P [Aic]{COOH} | 86 | 11 | 4 |
| 495 | {PDA}[AC4Abu][Aeea][Aeea] Q R P [NMeArg] L S H K G P [Nle]P [4-Cl-F] {COOH} | 75 | <1.0 | <1.0 |
| 508 | {Subericacid}[AC4Abu][Aeea][Aeea] Q R P [NMeArg] L S H K G P [Nle]P [4-Cl-F]{COOH} | <1.0 | <1.0 | <1.0 |
| 534 | {TDA}[AC4Abu][AC4Abu][Aeea][Aeea] q R P [NMeArg][Cha] S H K G [Oic] [Nle][Aib][4-Cl-F]{COOH} | >90.0 | 7 | 2 |
| 535 | {TDA}[AC4Abu][AC4Abu][Aeea] q R P [NMeArg][Cha] S H K G [Oic][Nle] [Aib][4-Cl-F]{COOH} | 89 | 3 | <1.0 |
| 375 | {TDA}[AC4Abu][Aeea][Aeea][aMeLeu] R P [NMeArg][aMeLeu] S H K G [Oic][Nle]P [4-Cl-F]{COOH} | 66 | 12 | 3 |
| 552 | {TDA}[AC4Abu][Aeea][Aeea][BLeu] R [aMePro][hArg][aMeLeu] S H K G [Oic][Nle][aMePro][4-Cl-F]{COOH} | >90.0 | 40 | 18 |
| 395 | {TDA}[AC4Abu][Aeea][Aeea][BLeu] R P [hArg][BLeu] S H K G [Oic][Nle] P [4-Cl-F]{COOH} | 83 | 2 | 1 |
| 374 | {TDA}[AC4Abu][Aeea][Aeea][BLeu] R P [NMeArg][aMeLeu] S H K G [Oic] [Nle]P [4-Cl-F]{COOH} | 66 | 11 | 89 |
| 388 | {TDA}[AC4Abu][Aeea][Aeea][BLeu] R P [NMeArg][aMeLeu] S H K G [Oic] Nle][aMePro][4-Cl-F]{COOH} | 72 | 18 | 16 |
| 394 | {TDA}[AC4Abu][Aeea][Aeea][BLeu] R P [NMeArg][BLeu] S H K G [Oic] [Nle]P [4-Cl-F]{COOH} | 86 | 8 | 2 |
| 393 | {TDA}[AC4Abu][Aeea][Aeea][BLeu] R P [NMeArg][Cha]S H K G [Oic][Nle] P [4-Cl-F]{COOH} | >90.0 | 12 | 2 |

TABLE 14-continued

Stability of Modified Apelin Polypeptides in Rat Plasma, Liver, and Kidney

| SEQ ID NO: | Sequence | Stability at 4 hours (% Remaining) Plasma | Liver | Kidney |
|---|---|---|---|---|
| 309 | {TDA}[AC4Abu][Aeea][Aeea][hArg] [hArg] Q [hArg]P [NMeArg][Cha] S H K G [Oic][Nle] P [4-Cl-F]{COOH} | >90.0 | 25.7 | 1.9 |
| 315 | {TDA}[AC4Abu][Aeea][Aeea][hArg] [Nle] Q [hArg] P r [NMeLeu] S H K G [Oic][pI-Phe] P [D-Bip]{COOH} | >90.0 | 86.1 | 54.8 |
| 490 | {TDA}[AC4Abu][Aeea][Aeea][hArg] Q [hArg] P [hArg][Cha] S H K G [Oic] Nle]P [4-Cl-F]{COOH} | 88 | 9 | <1.0 |
| 310 | {TDA}[AC4Abu][Aeea][Aeea][hArg] Q [hArg] P [NMeArg][Cha] S H K G [Oic][Nle]P [4-Cl-F]{COOH} | >90.0 | 15 | 1 |
| 328 | {TDA}[AC4Abu][Aeea][Aeea][hArg] r Q [Nle] P r [NMeLeu] S A K G [Oic] [pI-Phe]P [D-Bip]{COOH} | 76 | 0 | 55 |
| 347 | {TDA}[AC4Abu][Aeea][Aeea][Nle] Q R P [hArg][Cha] A A K G [Oic][Nle] P [4-Cl-F]{COOH} | 75 | 3 | 1 |
| 342 | {TDA}[AC4Abu][Aeea][Aeea][Nle] Q R P [hArg][Cha] S A K G [Oic][Nle] P [4-Cl-F]{COOH} | 76 | 6 | 2 |
| 338 | {TDA}[AC4Abu][Aeea][Aeea][Nle]Q R P [hArg][Cha]S H K G [Oic][Nle] P [4-Cl-F]{COOH} | 76 | 12 | 1 |
| 320 | {TDA}[AC4Abu][Aeea][Aeea][Nle] r Q [hArg] P r [NMeLeu] A H K G [Oic][pI-Phe]P [D-Bip]{COOH} | >90.0 | 86.5 | 73.4 |
| 314 | {TDA}[AC4Abu][Aeea][Aeea][Nle] r Q [hArg] P r [NMeLeu] S H K G [Oic][pI-Phe]P [D-Bip]{COOH} | >90.0 | 77.5 | 71 |
| 307 | {TDA}[AC4Abu][Aeea][Aeea] O F [hArg] [hArg][BLeu][hArg] P [hArg][Cha] S H K G [Oic][Nle] P [4-Cl-F]{COOH} | >90.0 | 66.8 | 13.8 |
| 297 | {TDA}[AC4Abu][Aeea][Aeea] O F [hArg][hArg] Q [NMeArg] P [NMeArg] [Cha] S H K G [Oic][Nle] P [4-Cl-F]{COOH} | >90.0 | 40.3 | <1.0 |
| 550 | {TDA}[AC4Abu][Aeea][Aeea] Q [BhPro] [NMeArg][Cha] S H K G [Oic][Nle] [Aib][4-Cl-F]{COOH} | >90.0 | 2 | <1.0 |
| 488 | {TDA}[AC4Abu][Aeea][Aeea] q [hArg] P [hArg][Cha] S H K G [Oic][Nle] P [4-Cl-F]{COOH} | 65 | 3 | <1.0 |
| 358 | {TDA}[AC4Abu][Aeea][Aeea] Q [hArg] P [hArg] L S H K G [Oic][Nle] P [4-Cl-F]{COOH} | 85 | 2.5 | 0.5 |
| 357 | {TDA}[AC4Abu][Aeea][Aeea] Q [hArg] P [hArg] L S H K G P [Nle] P [4-Cl-F] COOH} | 56 | 0 | 0 |
| 359 | {TDA}[AC4Abu][Aeea][Aeea] Q [hArg] P [NMeArg][aMeLeu] S H K G [Oic] [Nle]P [4-Cl-F]{COOH} | 62 | 3 | 2 |
| 473 | {TDA}[AC4Abu][Aeea][Aeea]Q [hArg] P [NMeArg][aMeLeu] S H K G P [Nle] P [2Nal]{COOH} | 82 | <1.0 | <1.0 |

TABLE 14-continued

| SEQ ID NO: | Sequence | Stability at 4 hours (% Remaining) Plasma | Liver | Kidney |
|---|---|---|---|---|
| 383 | {TDA}[AC4Abu][Aeea][Aeea] Q [hArg] P [NMeArg][BLeu] S H K G P [Nle] P [4-Cl-F]{COOH} | 31 | <1.0 | <1.0 |
| 362 | {TDA}[AC4Abu][Aeea][Aeea]Q [hArg] P [NMeArg][Cha]S H K G [Oic][Nle] P [4-Cl-F]{COOH} | 79 | 39 | 2.5 |
| 353 | {TDA}[AC4Abu][Aeea][Aeea]Q [hArg] P [NMeArg]L S H K G P [Nle]P [4-Cl-F]{COOH} | 20 | 0 | 0 |
| 483 | {TDA}[AC4Abu][Aeea][Aeea] Q [hArg] P [NMehArg] L S H K G P [Nle] P [4-CI-F]{COOH} | 37 | <1.0 | <1.0 |
| 372 | {TDA}[AC4Abu][Aeea][Aeea] q [hArg] P r [Cha] S A K G [Oic][Nle]P [4-Cl-F]{COOH} | 71 | 4 | 2 |
| 371 | {TDA}[AC4Abu][Aeea][Aeea] q [hArg] Pr [Cha]S H K [Tle][Oic][Nle]P [4-Cl-F]{COOH} | 90 | 81 | 28 |
| 363 | {TDA}[AC4Abu][Aeea][Aeea] q [hArg] P r [Cha] S H K G [Oic][Nle]P [4-Cl-F]{COOH} | 78 | No Result Obtained | 1 |
| 373 | {TDA}[AC4Abu][Aeea][Aeea] q [hArg]Pr [Cha] S Y K G [Oic][Nle]P [4-Cl-F]{COOH} | No Result Obtained | No Result Obtained | 64 |
| 397 | {TDA}[AC4Abu][Aeea][Aeea] Q [NMeArg] [aMeLeu] S H K G [Oic][Nle] P [4-Cl-F]{COOH} | 87 | 2 | 1 |
| 484 | {TDA}[AC4Abu][Aeea][Aeea] Q [NMehArg] P [NMeArg][aMeLeu] S H K G P [Nle]P [4-Cl-F]{COOH} | 79 | <1.0 | <1.0 |
| 475 | {TDA}[AC4Abu][Aeea][Aeea] Q E P [NMeArg] L S H K G P [Nle] P [4-Cl-F]{COOH} | 33 | <1.0 | <1.0 |
| 482 | {TDA}[AC4Abu][Aeea][Aeea] Q R [aMePro][hArg][aMeLeu] S H K G P [Nle] P [4-Cl-F]{COOH} | 62 | <1.0 | <1.0 |
| 392 | {TDA}[AC4Abu][Aeea][Aeea] Q R [aMePro] [hArg][BLeu] S H K G [Oic][Nle] P [4-Cl-F]{COOH} | 73 | 82 | <1.0 |
| 501 | {TDA}[AC4Abu][Aeea][Aeea] q R [aMePro] [hArg][BLeu] S H K G [Pip][Nle] 4-Cl-F]{COOH} | >90.0 | <1.0 | <1.0 |
| 502 | {TDA}[AC4Abu][Aeea][Aeea]q R [aMePro] [hArg][BLeu]S H K G [Oic][Nle] [aMePro][4-Cl-F]{COOH} | >90.0 | 34 | 19 |
| 503 | {TDA}[AC4Abu][Aeea][Aeea]q R [aMePro] [hArg][BLeu]S H K G [Pip][Nle] [aMePro][4-Cl-F]{COOH} | 85 | 7 | 2 |
| 504 | {TDA}[AC4Abu][Aeea][Aeea] q R [aMePro] [hArg][BLeu] S H K G [aMePro] [Nle][aMePro][4-Cl-F]{COOH} | >90.0 | 11 | 4 |
| 505 | {TDA}[AC4Abu][Aeea][Aeea] q R [aMePro][hArg] [BLeu] S H K G [Oic][Nle][Aib][4-Cl-F]{COOH} | 24 | No Result Obtained | No Result Obtained |
| 522 | {TDA}[AC4Abu][Aeea][Aeea]q R [BhPro] [hArg][BLeu] S H K G [Oic][Nle] [Aib][4-Cl-F]{COOH} | >90.0 | 15 | 7 |

Stability of Modified Apelin Polypeptides in Rat Plasma, Liver, and Kidney

TABLE 14-continued

Stability of Modified Apelin Polypeptides in Rat Plasma, Liver, and Kidney

| SEQ ID NO: | Sequence | Stability at 4 hours (% Remaining) Plasma | Liver | Kidney |
|---|---|---|---|---|
| 553 | {TDA}[AC4Abu][Aeea][Aeea] q R [BhPro] [NMeArg][aMeLeu] S H K G [Oic] [Nle][aMePro][4-Cl-F]{COOH} | >90.0 | 29 | 15 |
| 516 | {TDA}[AC4Abu][Aeea][Aeea] q R [BhPro] [NMeArg][Cha] S H K G [Oic][Nle] [Aib][4-Cl-F]{COOH} | >90.0 | 6 | 8 |
| 396 | {TDA}[AC4Abu][Aeea][Aeea] Q R [NMeArg] [aMeLeu] S H K G [Oic][Nle] P [4-Cl-F]{COOH} | >90.0 | <1.0 | <1.0 |
| 517 | {TDA}[AC4Abu][Aeea][Aeea] q R [Pip] [NMeArg][Cha] S H K G [Oic][Nle] [Aib][4-Cl-F]{COOH} | >90.0 | 19 | <1.0 |
| 476 | {TDA}[AC4Abu][Aeea][Aeea] Q R E [NMeArg] L S H K G P [Nle] P [4-Cl-F] {COOH} | 40 | <1.0 | <1.0 |
| 360 | {TDA}[AC4Abu][Aeea][Aeea] Q R P [hArg][aMeLeu] S H K G [Oic][Nle]P [4-Cl-F]{COOH} | 81.5 | 2.5 | 2 |
| 485 | {TDA}[AC4Abu][Aeea][Aeea] Q r P [hArg][aMeLeu] S H K G P [Nle]P [4-Cl-F]{COOH} | 74 | <1.0 | <1.0 |
| 378 | {TDA}[AC4Abu][Acea][Aeea] q R P [hArg] [BLeu] S H K G [Oic][Nle] P [4-Cl-F]{COOH} | 58 | 2 | 75 |
| 308 | {TDA}[AC4Abu][Acea][Aeea]Q R P [hArg] [Cha]S H K G [Oic][Nle]P [4-Cl-F]{COOH} | 76 | 6.2 | <1.0 |
| 356 | {TDA}[AC4Abu][Acea][Aeea] Q R P [hArg] L S H K G [Oic][Nle]P [4-Cl-F] {COOH} | 87 | 2 | 0 |
| 355 | {TDA}[AC4Abu][Aeea][Aeea] Q R P [hArg] L S H K G P [Nle]P [4-Cl-F] {COOH} | 64 | 0 | 0 |
| 387 | {TDA}[AC4Abu][Aeea][Aeea] Q R P [NMeArg][aMeLeu] S H K G [aMePro] [Nle] P [4-Cl-F]{COOH} | 73 | 4 | 1 |
| 376 | {TDA}[AC4Abu][Aeea][Aeea] Q R P [NMeArg][aMeLeu] S H K G [Oic][Nle] [aMePro][4-Cl-F]{COOH} | 83 | 10 | 13 |
| 385 | {TDA}[AC4Abu][Aeea][Aeea]Q R P [NMeArg][aMeLeu]S H K G [Oic][Nle]P 4-Cl-F]{COOH} | 65 | 5 | 4 |
| 386 | {TDA}[AC4Abu][Aeea][Aeea] q R P [NMeArg][aMeLeu] S H K G [Oic][Nle] P [4-Cl-F]{COOH} | 58 | 6 | 4 |
| 389 | {TDA}[AC4Abu][Aeea][Aeea] Q R P [NMeArg][aMeLeu] S H K G [Oic][Nle] [4-Cl-F]{COOH} | <1.0 | <1.0 | 4 |
| 554 | {TDA}[AC4Abu][Aeea][Aeea] q R P [NMeArg][aMeLeu] S H K G [Oic][Nle] [BhPro][4-Cl-F]{COOH} | >90.0 | 43 | 25 |
| 555 | {TDA}[AC4Abu][Aeea][Aeea] q R P [NMeArg][aMeLeu] S H K G [Pip][Nle] [aMePro][4-Cl-F]{COOH} | >90.0 | <1.0 | <1.0 |

TABLE 14-continued

| SEQ ID NO: | Sequence | Stability at 4 hours (% Remaining) Plasma | Liver | Kidney |
|---|---|---|---|---|
| | Stability of Modified Apelin Polypeptides in Rat Plasma, Liver, and Kidney | | | |
| 457 | {TDA}[AC4Abu][Aeea][Aeea]Q R P [NMeArg][aMeLeu]S H K G P [Nle]P [4-Cl-F]{COOH} | 62 | <1.0 | <1.0 |
| 422 | {TDA}[AC4Abu][Aeea][Aeea] Q R P [NMeArg][BhLeu] S H K G P [Nle]P [4-Cl-F]{COOH} | 37 | <1.0 | <1.0 |
| 391 | {TDA}[AC4Abu][Aeea][Aeea] Q R P [NMeArg][BLeu] S H K G [Oic][Nle] P [4-Cl-F]{COOH} | 2 | 5 | 2 |
| 500 | {TDA}[AC4Abu][Aeea][Aeea] q R P [NMeArg][Cha][BhSer] H K G [Oic][Nle] [Aib][4-Cl-F]{COOH} | >90.0 | 13 | <1.0 |
| 530 | {TDA}[AC4Abu][Aeea][Aeea] q R P [NMeArg][Cha] S A K G [Oic][Nle][Aib] 4-Cl-F]{COOH} | >90.0 | 3 | <1.0 |
| 418 | {TDA}[AC4Abu][Aeea][Aeea] Q R P [NMeArg][Cha] S H K G [aMePro][Nle]P 4-Cl-F]{COOH} | >90.0 | <1.0 | 8 |
| 498 | {TDA}[AC4Abu][Aeea][Aeea]q R P [NMeArg][Cha]S H K G [aMePro][Nle] [Aib][4-Cl-F]{COOH} | >90.0 | >90.0 | 23 |
| 377 | {TDA}[AC4Abu][Aeea][Aeea] q R P [NMeArg][Cha] S H K G [Oic][Nle] P [4-Cl-F]{COOH} | 65 | 4 | 99 |
| 379 | {TDA}[AC4Abu][Aeea][Aeea] Q R P [NMeArg][Cha] S H K G [Oic][Nle] P [BhPhe]{COOH} | 92 | 2 | 1 |
| 380 | {TDA}[AC4Abu][Aeea][Aeea] Q R P [NMeArg][Cha] S H K G [Oic][Nle] P [D-BhPhe]{COOH} | 97 | 2 | 1 |
| 382 | {TDA}[AC4Abu][Aeea][Aeea] Q R P [NMeArg][Cha] S H K G [Oic][Nle][Aib] [4-Cl-F]{COOH} | 91 | 6 | 2 |
| 390 | {TDA}[AC4Abu][Aeea][Aeea] Q R P [NMeArg][Cha] S H K G [Oic][Nle] P [4-Cl-F]{COOH} | 50 | 4 | 4 |
| 412 | {TDA}[AC4Abu][Aeea][Aeea] Q R P [NMeArg][Cha] S H K G [Oic][Nle] aMePro][4-Cl-F]{COOH} | 77 | 76 | 3 |
| 416 | {TDA}[AC4Abu][Aeea][Aeea] Q R P [NMeArg] [Cha] S H K G [Pip][Nle] P [4-Cl-F]{COOH} | 57.667 | No Result Obtained | No Result Obtained |
| 499 | {TDA}[AC4Abu][Aeea][Aeea] q R P [NMeArg][Cha] S H K G [Pip][Nle][Aib] [4-Cl-F]{COOH} | >90.0 | <1.0 | <1.0 |
| 361 | {TDA}[AC4Abu][Acea][Aeea] Q R P [NMeArg][Cha] S H K G P [Nle] P [4-Cl-F]{COOH} | 34.5 | 1.5 | 0.5 |
| 437 | {TDA}[AC4Abu][Aeea][Aeea] Q R P [NMeArg][Cha] S V K G [Oic][Nle] P [4-CI-F]{COOH} | 62 | 6 | 5 |
| 531 | {TDA}[AC4Abu][Aeea][Aeea] q R P [NMeArg][Cha] S Y K G [Oic][Nle][Aib] [4-Cl-F]{COOH} | >90.0 | 13 | <1.0 |

TABLE 14-continued

| Stability of Modified Apelin Polypeptides in Rat Plasma, Liver, and Kidney | | | | |
|---|---|---|---|---|
| SEQ ID NO: | Sequence | Stability at 4 hours (% Remaining) Plasma | Liver | Kidney |
| 464 | {TDA}[AC4Abu][Acea][Aeea]Q R P [NMeArg]L [bAla]H K G P [Nle]P [4-Cl-F]{COOH} | 21 | <1.0 | <1.0 |
| 467 | {TDA}[AC4Abu][Aeea][Aeea] Q R P [NMeArg]L [NhSerG] H K G P [Nle] P [4-Cl-F]{COOH} | 27 | 87 | 83 |
| 469 | {TDA}[AC4Abu][Aeea][Aeea] Q R P [NMeArg] L S [rHis] K G P [Nle] P [4-Cl-F]{COOH} | 36 | <1.0 | <1.0 |
| 424 | {TDA}[AC4Abu][Aeea][Aeea] Q R P [NMeArg] L S H [bAla]G P [Nle] P [4-Cl-F]{COOH} | 2 | <1.0 | <1.0 |
| 352 | {TDA}[AC4Abu][Aeea][Aeea] Q R P [NMeArg] L S H K G [Oic][Nle] P [4-Cl-F]{COOH} | 88 | 0 | 0 |
| 402 | {TDA}[AC4Abu][Aeea][Aeea] Q R P [NMeArg] L S H K G P [Nle][4-Cl-F] {COOH} | 87 | <1.0 | <1.0 |
| 401 | {TDA}[AC4Abu][Aeea][Aeea] Q R P [NMeArg] L S H K G P [Nle][aMePro][4-Cl-F]{COOH} | 6 | 1 | 3 |
| 425 | {TDA}[AC4Abu][Aeea][Aeea] Q R P [NMeArg] L S H K G P [Nle][bAla][4-Cl-F]{COOH} | >90.0 | <1.0 | <1.0 |
| 426 | {TDA}[AC4Abu][Aeea][Aeea] Q R P [NMeArg] L S H K G P [Nle][BhPro][4-Cl-F]{COOH} | 33 | <1.0 | <1.0 |
| 287 | {TDA}[AC4Abu][Aeea][Aeea] Q R P [NMeArg] L S H K G P [Nle] P [4-Cl-F] {COOH} | 18 | <1.0 | <1.0 |
| 384 | {TDA}[AC4Abu][Aeea][Aeea] Q R P [NMehArg][BLeu] S H K G P [Nle] P [4-Cl-F]{COOH} | 25 | <1.0 | <1.0 |
| 471 | {TDA}[AC4Abu][Aeea][Aeea] Q R P [NMehArg] L S H K G P [Nle]P [2Nal] {COOH} | 52 | <1.0 | <1.0 |
| 526 | {TDA}[AC4Abu][Aeea][Aeea] q R P E [Cha] S H K G [Oic][Nle][Aib][4-Cl-F] {COOH} | >90.0 | 5 | <1.0 |
| 477 | {TDA}[AC4Abu][Aeea][Aeea] Q R P E L S H K G P [Nle] P [4-Cl-F]{COOH} | 64 | <1.0 | 2 |
| 348 | {TDA}[AC4Abu][Acea][Aeea] R Q [Nle] P [hArg][Cha] A A K G [Oic][Nle] P 4-Cl-F]{COOH} | 75 | 5 | 1 |
| 343 | {TDA}[AC4Abu][Aeea][Aeea] R Q [Nle] P [hArg][Cha] S A K G [Oic][Nle] P 4-Cl-F]{COOH} | 80 | 6 | 2 |
| 564 | {TDA}[AC4Abu][Aeea][Aeea] R Q [Nle] P [hArg][Cha] S A K G [Pip][Nle]P 4-Cl-F]{COOH} | >90.0 | 2 | <1.0 |
| 339 | {TDA}[AC4Abu][Aeea][Aeea] R Q [Nle] P [hArg][Cha] S H K G [Oic][Nle]P [4-Cl-F]{COOH} | 93 | 13 | 2 |

TABLE 14-continued

Stability of Modified Apelin Polypeptides in Rat Plasma, Liver, and Kidney

| SEQ ID NO: | Sequence | Stability at 4 hours (% Remaining) Plasma | Liver | Kidney |
|---|---|---|---|---|
| 344 | {TDA}[AC4Abu][Aeea][Aeea] R Q R P [Nle][Cha] A H K G [Oic][Nle] P [4-Cl-F]{COOH} | 88 | 6 | 0 |
| 539 | {TDA}[AC4Abu][NPeg11] q R P [NMeArg] [Cha] S H K G [Oic][Nle][Aib][4-Cl-F]{COOH} | 63 | 3 | <1.0 |
| 538 | {TDA} d [Aeea][Aeea] q R P [NMeArg] [Cha] S H K G [Oic][Nle][Aib][4-Cl-F] {COOH} | 73 | 2 | <1.0 |
| 537 | {TDA} E [Aeea][Aeea] q R P [NMeArg] [Cha] S H K G [Oic][Nle][Aib][4-Cl-F] {COOH} | >90.0 | 15 | <1.0 |

Based on the results of these stability studies, sites of metabolism were identified within the modified apelin polypeptides and these sites were substituted with metabolically more stable amino acids. Non-natural amino acids were introduced through chemical synthesis in order to block metabolism or reduce recognition by peptidases. An N-Methyl amino acid at positions corresponding to amino acids 66 (NMeArg66), 68 (NMeArg68), and 69 (NMeLeu69) in SEQ ID NO: 2, an N-alkyl amino acid at position corresponding to amino acid 70 (NhSerG70) in SEQ ID NO: 2, and an alpha-methyl amino acid at positions corresponding to amino acids 67 (aMePro67), 69 (aMeLeu69), 74 (aMePro74), and 76 (aMePro76) in SEQ ID N: 2 can sterically hinder access of peptidases to bonds in the apelin peptides. D-amino acids at positions corresponding to amino acids 64, 65, 66, and 68 in SEQ ID NO: 2 (r64, q65, r66, r68) and beta-amino acids at positions corresponding to amino acids 65, 69, 70, 76, and 77 in SEQ ID NO: 2 (BLeu65, BLeu69, BhSer70, BhPro76, D-BhPhe77) can avoid recognition of peptidases that cleave endogenous peptides containing L-amino acids. $\psi(CH_2NH)$-reduced amide bond amino acids, for example at a position corresponding to amino acid 75 in SEQ ID NO: 2 (rNle75), replace an amide bond with a more stable amine bond. Cyclic peptides are not recognized by exopeptidases and sterically hinder access by other peptidases. Oxidative metabolism at methionine75 in the native sequence (amino acid positions relative to SEQ ID NO: 2) was avoided by substitution with norleucine75. The combination of NMeLeu, pI-Phe, and D-Bip at positions corresponding to amino acids 69, 75, and 77, respectively, in SEQ ID NO: 2 gave particularly stable peptides. Conjugation with lipid or PEG improved in vitro stability of the peptides and reduced clearance in vivo.

An in vivo pharmacokinetics analysis in rat was conducted for four lipidated apelin peptides (SEQ ID NOs: 286, 376, 379, and 382) according to the methods described in Example 6. Table 15 below summarizes the results of the pharmacokinetic study.

TABLE 15

Rat PK Analysis for Modified Apelin Polypeptides

| Apelin Peptide SEQ ID NO. | S.C. Bolus Dose (mg/kg) | $AUC_{inf}$ (μM · h)) | CL (L/(h · kg)) | t½ (h) |
|---|---|---|---|---|
| 286 | 0.1 | 0.378 | 0.099 | 2.31 |
| | 0.5 | 1.059 | 0.200 | 2.59 |
| 376 | 0.1 | 0.272 | 0.164 | 0.446 |
| | 0.5 | 0.090 | 2.50 | 1.48 |
| 379 | 0.1 | 0.145 | 0.304 | 0.261 |
| | 0.5 | 0.052 | 4.28 | 2.27 |
| 382 | 0.1 | 0.336 | 0.135 | 0.485 |
| | 0.5 | 0.0961 | 2.40 | 4.10 |

Example 10. Modified Apelin Polypeptides with Improved Potency

In some cases, modification of the apelin polypeptides to increase stability led to a decrease in potency of the peptides for activating the APJ receptor. To improve the APJ agonist potency of the stabilized peptides, a further SAR study was conducted. The modified apelin polypeptides in Table 16 below were tested for APJ agonist activity using the GTPγS assay as described in Example 3. EC50 values are provided for each modified polypeptide for activation of the human and rat APJ receptors.

The results show that potency and efficacy of the peptides could be obtained by preserving features of the sidechains of the native apelin-13 sequence (SEQ ID NO: 4), while the peptide backbone was modified for stability. At the N-terminus of the modified polypeptide, the sequence: hArg hArg Q hArg P (SEQ ID NO: 715) at positions corresponding to amino acids 63 to 67 of SEQ ID NO: 2 provided good potency. At positions corresponding to amino acids 68 and 69 of SEQ ID NO: 2, the following pairs of substitutions gave potent agonists: (i) NMeArg and aMeLeu, (ii) hArg and BLeu, (iii) hArg and aMeLeu, and (iv) NMehArg and L. Positions within the modified polypeptides corresponding to amino acids 70 to 73 of SEQ ID NO: 2 were less amenable to substitutions, however BhSer70, NhSerG70, Y71 and NLysG72 were tolerated. At the amino acid position in the modified polypeptide corresponding to amino acid 74 of SEQ ID NO: 2, Oic and aMePro were preferred for achieving potent peptides, and Pip at this position also tended to improve potency. At the amino acid position in the modified polypeptide corresponding to amino acid 75 of SEQ ID NO: 2, Nle or rNle gave potent compounds. C terminal residues (positions corresponding to amino acids 76 and 77 of SEQ ID NO: 2) were critical to both activity and stability. BhPro, aMePro, or Aib at the position corresponding to amino acid 76 and D-BhPhe or 4-Cl-F at the position corresponding to amino acid 77 gave a good balance of potency and stability.

N-terminal lipid conjugation had little effect on potency or efficacy. PEG and Fc conjugates (see Example 11) were not soluble in DMSO and in vitro assays were run from aqueous stocks. In the absence of DMSO, potency and efficacy read-outs were generally reduced in the GTPγS assay. However, relative to [MerPr](10K-mPEGacetamideReg)-apelin13 run under the same conditions (hAPJ EC50 0.21 μM; rAPJ EC50 0.39 μM), PEG and Fc conjugates of the modified polypeptides were potent full APJ agonists.

TABLE 16

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 88 | {Acetyl-NH} [AC4Abu] [Aeea] [Aeea] Q R P [NMeArg] L S H K G P [Nle] P [4-Cl-F] {COOH} | 0.0002195 | 0.000388 |
| 76 | {Acetyl-NH} [hArg] E Q [hArg] P r [NMeLeu] S H K G [Oic] [pI-Phe] P [D-Bip] {COOH} | 0.001845 | 0.000994 |
| 60 | {Acetyl-NH} [hArg] Q [hArg] P [NMeArg] [Cha] S H K G [Oic] [Nle] P [4-Cl-F] {COOH} | 0.00022412 | 0.0044764 |
| 78 | {Acetyl-NH} [hArg] r Q [hArg] E r [NMeLeu] S H K G [Oic] [pI-Phe] P [D-Bip] {COOH} | 0.000882 | 0.000871 |
| 79 | {Acetyl-NH} [hArg] r Q [hArg] P E [NMeLeu] S H K G [Oic] [pI-Phe] P [D-Bip] {COOH} | 0.000678 | 0.000341 |
| 81 | {Acetyl-NH} [hArg] r Q [hArg] P r [NMeLeu] E H K G [Oic] [pI-Phe] P [D-Bip] {COOH} | 0.08385 | 0.0706 |
| 82 | {Acetyl-NH} [hArg] r Q [hArg] P r [NMeLeu] S E K G [Oic] [pI-Phe] P [D-Bip] {COOH} | 0.02315 | 0.0539 |
| 83 | {Acetyl-NH} [hArg] r Q [hArg] P r [NMeLeu] S H E G [Oic] [pI-Phe] P [D-Bip] {COOH} | 0.0545 | 0.0847 |
| 84 | {Acetyl-NH} [hArg] r Q [hArg] P r [NMeLeu] S H K E [Oic] [pI-Phe] P [D-Bip] {COOH} | 0.01815 | 0.0893 |
| 87 | {Acetyl-NH} [hArg] r Q [hArg] P r [NMeLeu] S H K G [Oic] [pI-Phe] E [D-Bip] {COOH} | 0.05265 | 0.0589 |
| 86 | {Acetyl-NH} [hArg] r Q [hArg] P r [NMeLeu] S H K G [Oic] E P [D-Bip] {COOH} | >4.17 | >4.17 |
| 85 | {Acetyl-NH} [hArg] r Q [hArg] P r [NMeLeu] S H K G E [pI-Phe] P [D-Bip] {COOH} | >4.17 | >4.17 |
| 80 | {Acetyl-NH} [hArg] r Q [hArg] P r E S H K G [Oic] [pI-Phe] P [D-Bip] {COOH} | 0.1273 | 0.06865 |
| 77 | {Acetyl-NH} [hArg] r Q E P r [NMeLeu] S H K G [Oic] [pI-Phe] P [D-Bip] {COOH} | 0.00492 | 0.002845 |
| 75 | {Acetyl-NH} E r Q [hArg] P r [NMeLeu] S H K G [Oic] [pI-Phe] P [D-Bip] {COOH} | 0.00156 | 0.0010805 |
| 74 | {Acetyl-NH} Q [hArg] [NMehArg] L S H K G P [Nle] P [4-Cl-F] {COOH} | 0.00048 | 0.0173 |
| 71 | {Acetyl-NH} Q [hArg] P [NMeArg] [aMeLeu] S H K G P [Nle] P [4-Cl-F] {COOH} | 0.0000921 | 0.00275 |
| 61 | {Acetyl-NH} Q [hArg] P [NMeArg] [Cha] S H K G [Oic] [Nle] P [4-Cl-F] {COOH} | 0.00015933 | 0.000189 |
| 69 | {Acetyl-NH} Q R [aMePro] [hArg] [aMeLeu] S H K G P [Nle] P [4-Cl-F] {COOH} | 0.0000417 | 0.0003135 |
| 72 | {Acetyl-NH} Q R [NMeArg] L S H K G P [Nle] P [4-Cl-F] {COOH} | 0.0013575 | 0.04065 |

TABLE 16-continued

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 73 | {Acetyl-NH} Q R [NMehArg] L S H K G P [Nle] P [4-Cl-F] {COOH} | 0.0018115 | 0.047225 |
| 70 | {Acetyl-NH} Q r P [hArg] [aMeLeu] S H K G P [Nle] P [4-Cl-F] {COOH} | 0.0001925 | 0.009735 |
| 93 | {Acetyl-NH} q R P [NMeArg] [Cha] S H K G [aMePro] [Nle] [Aib] [4-Cl-F] {COOH} | 0.0002295 | 0.0007905 |
| 92 | {Acetyl-NH} Q R P [NMeArg] [Cha] S H K G [Oic] [Nle] [Aib] [4-Cl-F] {COOH} | 0.000679 | 0.0032275 |
| 68 | {Acetyl-NH} Q R P [NMeArg] L S H K G P [Nle] P [4-Cl-F] {COOH} | 0.0000842 | 0.00038429 |
| 91 | {Acetyl-NH} R L I E D I C L P R W G C L W [Aeea] [Aeea] Q R P [NMeArg] L S H K G P [Nle] P [4-Cl-F] {COOH} | 0.0000357 | 0.000124 |
| 90 | {Acetyl-NH} R L I E D I C L P R W G C L W E D D [Aeea] [Aeea] Q R P [NMeArg] L S H K G P [Nle] P [4-Cl-F] {COOH} | 0.0001395 | 0.0006325 |
| 66 | {Acetyl-NH} R Q R P [NMeArg] [Cha] S H K G P [Nle] P [4-Cl-F] {COOH} | 0.000040467 | 0.00015567 |
| 67 | {Acetyl-NH} R Q R P [NMeArg] [NMeLeu] S H K G P [Nle] P [4-Cl-F] {COOH} | 0.00018467 | 0.0014023 |
| 65 | {Acetyl-NH} R Q R P [NMeArg] L S H K G P [Nle] P [4-Cl-F] {COOH} | 0.0000302 | 0.00012227 |
| 63 | {Acetyl-NH} R Q R P R [Cha] S H K G P [Nle] P [4-Cl-F] {COOH} | 0.000035967 | 0.00016433 |
| 64 | {Acetyl-NH} R Q R P R [NMeLeu] S H K G P [Nle] P [4-Cl-F] {COOH} | 0.000055533 | 0.00041067 |
| 62 | {Acetyl-NH} R Q R P R L S H K G P [Nle] P [D-Bip] {COOH} | 0.00030333 | 0.0034333 |
| 94 | {Acetyl-NH} S D F Y K R L I N K A K [Aeea] [Aeea] [hArg] r Q [hArg] P r [NMeLeu] S H K G [Oic] [pI-Phe] P [D-Bip] {COOH} | 0.0013415 | 0.00133 |
| 89 | {Acetyl-NH} S D F Y K R L I N K A K [Aeea] [Aeea] Q R P [NMeArg] L S H K G P [Nle] P [4-Cl-F] {COOH} | 0.0000389 | 0.00010095 |
| 515 | {AdpA} [AC4Abu] [Aeea] [Aeea] Q r P [hArg] [aMeLeu] S H K G P [Nle] P [4-Cl-F] {COOH} | 0.001815 | 0.005935 |
| 461 | {AdpA} [AC4Abu] [Aeea] [Aeea] Q R P [NMeArg] L S H K G P [Nle]P [4-Cl-F] {COOH} | 0.0002029 | 0.00099975 |
| 491 | {Butanoyl} [AC4Abu] [Aeea] [Aeea] Q R P [NMeArg] L S H K G P [Nle] P [4-Cl-F] {COOH} | 0.00006745 | 0.000453 |
| 349 | {DDDA} [AC4Abu] [Aeea] [Aeea] Q [hArg] P r [NMeLeu] S H K G [Oic] [pI-Phe] P [D-Bip] {COOH} | 0.06395 | 0.047833 |
| 510 | {DDDA} [AC4Abu] [Aeea] [Aeea] Q R P [NMeArg] L S H K G P [Nle] P [4-Cl-F] {COOH} | 0.0002075 | 0.000903 |
| 494 | {Decanoyl} [AC4Abu] [Aeea] [Aeea] Q R P [NMeArg] L S H K G P [Nle] P [4-Cl-F] {COOH} | 0.00002215 | 0.0001465 |
| 591 | {Dodecanoyl-NH} [AC4Abu] [Aeea] [Aeea] Q R P [NMeArg] L S H K G P [Nle] P [4-Cl-F] {COOH} | 0.0004755 | 0.00184 |

TABLE 16-continued

| APJ Agonist Activity of Modified Apelin Polypeptides | | | |
|---|---|---|---|
| SEQ ID NO: | SEQUENCE | EC50 Human APJ Receptor (μM) | EC50 Rat APJ Receptor (μM) |
| 111 | {H2} [MerPr] (10K mPEG acetamide) q [hArg] P [NMeArg] [Cha] S H K G [Oic] [Nle] P [D-4ClF] {COOH} | 1.095 | 0.777 |
| 112 | {H2} [MerPr] (10K mPEG acetamide) Q [hArg] P [NMeArg] [aMeLeu] S H K G P [Nle] P [4-Cl-F] {COOH} | 0.00232 | 0.010435 |
| 113 | {H2} [MerPr] (10K mPEG acetamide) Q [hArg] P [NMehArg] L S H K G P [Nle] P [4-Cl-F] {COOH} | 0.01214 | 0.0493 |
| 114 | {H2} [MerPr] (10K mPEG acetamide) Q R [aMePro] [hArg] [aMeLeu] S H K G P [Nle] P [4-Cl-F] {COOH} | 0.000848 | 0.003455 |
| 117 | {H2} [MerPr] (10K mPEG acetamide) Q R P [hArg] [aMeLeu] S H K G P [Nle] P [4-Cl-F] {COOH} | 0.01965 | 0.11715 |
| 119 | {H2} [MerPr] (10K mPEG acetamide) Q r P [hArg] [aMeLeu] S H K G P [Nle] P [4-Cl-F] {COOH} | 0.0256 | 0.141 |
| 120 | {H2} [MerPr] (10K mPEG acetamide) Q R P [NMeArg] [Cha] S H K G [Oic] [Nle] [Aib] [4-Cl-F] {COOH} | 0.0632 | 0.2585 |
| 115 | {H2} [MerPr] (10K mPEG acetamide) Q R P [NMeArg] L S H K G P [Nle] P [4-Cl-F] {COOH} | 0.00166 | 0.00649 |
| 116 | {H2} [MerPr] (10K mPEG acetamide) Q [NMehArg] P [NMeArg] [aMeLeu] S H K G P [Nle] P [4-Cl-F] {COOH} | 0.009715 | 0.0408 |
| 110 | {H2} [MerPr] (10K mPEG acetamide) Q R P R L S H K G P M P F {COOH} | 0.21 | 0.3915 |
| 13 | {H2} C M P L H S R V P F P {COOH} | 0.0703 | 0.50367 |
| 548 | {H2} H A E G T F T S D V S S Y L E G Q A A K (AC4Abu-Palm) E F I A W L V R G R G {COOH} | | |
| 12 | {H2} K F R R Q R P R L S H K G P M P { COOH} | 0.0014167 | 0.0058083 |
| 14 | {H2} K L R K H N [Abu] L Q R R [Abu] M P L H S R V P F P {COOH} | 0.000301 | 0.032433 |
| 15 | {H2} K L R K H N C L Q R R C M P L H S R V P F P {COOH} | 0.00013123 | 0.016087 |
| 576 | {HDA} [AC4Abu] [Aeea] [Aeea] q R P [NMeArg] [Cha] S H K G [Oic] [Nle] P [D-4ClF] {COOH} | 0.003335 | 0.005165 |
| 496 | {HDA} [AC4Abu] [Aeea] [Aeea] Q R P [NMeArg] L S H K G P [Nle] P [4-Cl-F] {COOH} | 0.0000874 | 0.0004815 |
| 506 | {hexanoyl} [AC4Abu] [Aeea] [Aeea] [Aeea] [hArg] Q [hArg] P [NMeArg] [Cha] S H K G [Oic] [Nle] P [4-Cl-F] {COOH} | 0.0034925 | 0.013238 |
| 286 | {hexanoyl} [AC4Abu] [Aeea] [Aeea] [hArg] r Q [hArg] P r [NMeLeu] S H K G [Oic] [pI-Phe] P [D-Bip] {COOH} | 0.00162 | 0.003074 |
| 563 | {hexanoyl} [AC4Abu] [Aeea] [Aeea] [hArg] r Q [hArg] P r [NMeLeu] S H K G [Pip] [pI-Phe] P [D-Bip] {COOH} | 0.0043 | 0.012745 |
| 561 | {hexanoyl} [AC4Abu] [Aeea] [Aeea] Q [NMehArg] P [NMeArg][aMeLeu] S H K G P [Nle] P [4-Cl-F] {COOH} | 0.0012083 | 0.0059375 |
| 560 | {hexanoyl} [AC4Abu] [Aeea] [Aeea] Q R [aMePro] [hArg] [aMeLeu] S H K G P [Nle] P [4-Cl-F] {COOH} | 0.0000553 | 0.000274 |

TABLE 16-continued

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 514 | {hexanoyl} [AC4Abu] [Aeea] [Aeea] Q r P [hArg] [aMeLeu] S H K G P [Nle] P [4-Cl-F] {COOH} | 0.000485 | 0.00669 |
| 559 | {hexanoyl} [AC4Abu] [Aeea] [Aeea] Q R P [hArg] [aMeLeu] S H K G P [Nle] P [4-Cl-F] {COOH} | 0.00116 | 0.009155 |
| 562 | {hexanoyl} [AC4Abu] [Aeea] [Aeea] Q R P [NMeArg] [Cha] S H K G [Oic] [Nle] [Aib] [4-Cl-F] {COOH} | 0.00385 | 0.016275 |
| 492 | {hexanoyl} [AC4Abu] [Aeea] [Aeea] Q R P [NMeArg] L S H K G P [Nle] P [4-Cl-F] {COOH} | 0.00003755 | 0.000147 |
| 566 | {hexanoyl} [Ahx] [AC4Abu] [Aeea] [Aeea] [hArg] r Q [hArg] P r [NMeLeu] S H K G [Oic] [pI-Phe] P [D-Bip] {COOH} | 0.0011335 | 0.00165 |
| 512 | {HexDDA} [AC4Abu] [Aeea] [Aeea] Q R P [NMeArg] L S H K G P [Nle] P [4-Cl-F] {COOH} | 0.0006585 | 0.004595 |
| 592 | {Myristyl-NH} [AC4Abu] [Aeea] [Aeea] Q R P [NMeArg] L S H K G P [Nle] P [4-Cl-F] {COOH} | 0.0002765 | 0.0005975 |
| 493 | {Oc} [AC4Abu] [Aeea] [Aeea] Q R P [NMeArg] L S H K G P [Nle] P [4-Cl-F] {COOH} | 0.00012008 | 0.000647 |
| 513 | {ODDA} [AC4Abu] [Aeea] [Aeea] Q R P [NMeArg] L S H K G P [Nle] P [4-Cl-F] {COOH} | 0.0008815 | 0.00612 |
| 290 | {ODDA} [AC4Abu] [Aeea] [Aeea] Q R P R L S H K G P M P F {COOH} | 0.0401 | 0.17285 |
| 614 | {Palm} [AC4Abu] [Aeea] [Aeea] q [hArg] P r [Cha] S H K G [Oic] [Nle] P [D-BhPhe] {COOH} | 0.001245 | 0.010275 |
| 646 | {Palm} [AC4Abu] [Aeea] [Aeea] q [NPipG] P [NMeArg] [Cha] S H K G [Pip] [Nle] [Aib] [4-Cl-F] {COOH} | 0.0002695 | 0.0009935 |
| 627 | {Palm} [AC4Abu] [Aeea] [Aeea] q R P [NMeArg] [aMeLeu] [aMeS] H K G [Oic] [Nle] [BhPro] [4-Cl-F] {COOH} | 0.0002435 | 0.000641 |
| 628 | {Palm} [AC4Abu] [Aeea] [Aeea] q R P [NMeArg] [aMeLeu] [BLeu] H K G [Oic] [Nle] [BhPro] [4-Cl-F] {COOH} | 0.0003095 | 0.0007735 |
| 629 | {Palm} [AC4Abu] [Aeea] [Aeea] q R P [NMeArg] [aMeLeu] S [Bip] K G [Oic] [Nle] [BhPro] [4-Cl-F] {COOH} | 0.002445 | 0.005305 |
| 630 | {Palm} [AC4Abu] [Aeea] [Aeea] q R P [NMeArg] [aMeLeu] S [Dap] K G [Oic] [Nle] [BhPro] [4-Cl-F] {COOH} | 0.000203 | 0.0004865 |
| 636 | {Palm} [AC4Abu] [Aeea] [Aeea] q R P [NMeArg] [aMeLeu] S H [3Pal] G [Oic] [Nle] [BhPro] [4-Cl-F] {COOH} | 0.001587 | 0.00365 |
| 637 | {Palm} [AC4Abu] [Aeea] [Aeea] q R P [NMeArg] [aMeLeu] S H [4-F-F] G [Oic] [Nle] [BhPro] [4-Cl-F] {COOH} | 0.00405 | 0.014155 |
| 635 | {Palm} [AC4Abu] [Aeea] [Aeea] q R P [NMeArg] [aMeLeu] S H [aMeOrn] G [Oic] [Nle] [BhPro] [4-Cl-F] {COOH} | 0.0016185 | 0.006645 |
| 638 | {Palm} [AC4Abu] [Aeea] [Aeea] q R P [NMeArg] [aMeLeu] S H [Dab] G [Oic] [Nle] [BhPro] [4-Cl-F] {COOH} | 0.0032 | 0.00932 |

TABLE 16-continued

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 639 | {Palm} [AC4Abu] [Aeea] [Aeea] q R P [NMeArg] [aMeLeu] S H [Dap] G [Oic] [Nle] [BhPro] [4-Cl-F] {COOH} | 0.00328 | 0.0154 |
| 640 | {Palm} [AC4Abu] [Aeea] [Aeea] q R P [NMeArg] [aMeLeu] S H [Igl] G [Oic] [Nle] [BhPro] [4-Cl-F] {COOH} | 0.004025 | 0.0252 |
| 632 | {Palm} [AC4Abu] [Aeea] [Aeea] q R P [NMeArg] [aMeLeu] S H [NPipG] G [Oic] [Nle] [BhPro] [4-Cl-F] {COOH} | 0.00302 | 0.022 |
| 641 | {Palm} [AC4Abu] [Aeea] [Aeea] q R P [NMeArg] [aMeLeu] S H K [Sar] [Oic] [Nle] [BhPro] [4-Cl-F] {COOH} | 0.00058 | 0.00366 |
| 631 | {Palm} [AC4Abu] [Aeea] [Aeea] q R P [NMeArg] [aMeLeu] S h K G [Oic] [Nle] [BhPro] [4-Cl-F] {COOH} | 0.0003385 | 0.0006985 |
| 634 | {Palm} [AC4Abu] [Aeea] [Aeea] q R P [NMeArg] [aMeLeu] S H O G [Oic] [Nle] [BhPro] [4-Cl-F] {COOH} | 0.0001645 | 0.002205 |
| 642 | {Palm} [AC4Abu] [Aeea] [Aeea] q R P [NMeArg] [Cha] [aMeS] H K G [Oic] [Nle] [BhPro] [D-BhPhe] {COOH} | 0.000332 | 0.001367 |
| 615 | {Palm} [AC4Abu] [Aeea] [Aeea] q R P [NMeArg] [Cha] [BLeu] H K G [Oic] [Nle] [BhPro] [D-BhPhe] {COOH} | 0.00942 | 0.02315 |
| 643 | {Palm} [AC4Abu] [Aeea] [Aeea] q R P [NMeArg] [Cha] [NPrG] H K G [Pip] [Nle] [Aib] [4-Cl-F] {COOH} | 0.000463 | 0.0037905 |
| 616 | {Palm} [AC4Abu] [Aeea] [Aeea] q R P [NMeArg] [Cha] S [Dap] K G [Oic] [Nle] [BhPro] [D-BhPhe] {COOH} | 0.002755 | 0.01725 |
| 644 | {Palm} [AC4Abu] [Aeea] [Aeea] q R P [NMeArg] [Cha] S [NPrG] K G [Pip] [Nle] [Aib] [4-Cl-F] {COOH} | 0.001397 | 0.004195 |
| 620 | {Palm} [AC4Abu] [Aeea] [Aeea] q R P [NMeArg] [Cha] S H [3Pal] G [Oic] [Nle] [BhPro] [D-BhPhe] {COOH} | 0.00742 | 0.01487 |
| 621 | {Palm} [AC4Abu] [Aeea] [Aeea] q R P [NMeArg] [Cha] S H [4-Cl-F] G [Oic] [Nle] [BhPro] [D-BhPhe] {COOH} | 0.016415 | 0.0261 |
| 622 | {Palm} [AC4Abu] [Aeea] [Aeea] q R P [NMeArg] [Cha] S H [4-F-F] G [Oic] [Nle] [BhPro] [D-BhPhe] {COOH} | 0.01183 | 0.01965 |
| 619 | {Palm} [AC4Abu] [Aeea] [Aeea] q R P [NMeArg] [Cha] S H [aMeOrn] G [Oic] [Nle] [BhPro] [D-BhPhe] {COOH} | 0.0262 | 0.125 |
| 623 | {Palm} [AC4Abu] [Aeea] [Aeea] q R P [NMeArg] [Cha] S H [Dab] G [Oic] [Nle] [BhPro] [D-BhPhe] {COOH} | 0.001425 | 0.009165 |
| 624 | {Palm} [AC4Abu] [Aeea] [Aeea] q R P [NMeArg] [Cha] S H [Dap] G [Oic] [Nle] [BhPro] [D-BhPhe] {COOH} | 0.02105 | 0.09965 |
| 625 | {Palm} [AC4Abu] [Aeea] [Aeea] q R P [NMeArg] [Cha] S H [Igl] G [Oic] [Nle] [BhPro] [D-BhPhe] {COOH} | 0.0111 | 0.02005 |

TABLE 16-continued

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 633 | {Palm} [AC4Abu] [Aeea] [Aeea] q R P [NMeArg] [Cha] S H [NPipG] G [Oic] [Nle] [BhPro] [D-BhPhe] {COOH} | 0.0107 | >4.17 [2] |
| 626 | {Palm} [AC4Abu] [Aeea] [Aeea] q R P [NMeArg] [Cha] S H K [Sar] [Oic] [Nle] [BhPro] [D-BhPhe] {COOH} | 0.01217 | 0.02465 |
| 613 | {Palm} [AC4Abu] [Aeea] [Aeea] q R P [NMeArg] [Cha] S H K G [BhPro] [Nle] [4-Cl-F] {COOH} | 0.00166 | 0.0388 |
| 583 | {Palm} [AC4Abu] [Aeea] [Aeea] q R P [NMeArg] [Cha] S H K G [Inp] [Nle] [Aib] [4-Cl-F] {COOH} | 0.005965 | 0.0492 |
| 582 | {Palm} [AC4Abu] [Aeea] [Aeea] q R P [NMeArg] [Cha] S H K G [Nip] [Nle] [Aib] [4-Cl-F] {COOH} | 0.0085 | 0.0293 |
| 567 | {Palm} [AC4Abu] [Aeea] [Aeea] q R P [NMeArg] [Cha] S H K G [Oic] [Nle] P [D-BhPhe] {COOH} | 0.005145 | 0.00889 |
| 569 | {Palm} [AC4Abu] [Aeea] [Aeea] q R P [NMeArg] [Cha] S H K G [Oic] [Nle] [Aib] [D-BhPhe] {COOH} | 0.001 | 0.0009915 |
| 570 | {Palm} [AC4Abu] [Aeea] [Aeea] q R P [NMeArg] [Cha] S H K G [Oic] [Nle] [aMePro] [D-BhPhe] {COOH} | 0.008005 | 0.01975 |
| 571 | {Palm} [AC4Abu] [Aeea] [Aeea] q R P [NMeArg] [Cha] S H K G [Oic] [Nle] [BhPro] [D-BhPhe] {COOH} | 0.001485 | 0.004805 |
| 572 | {Palm} [AC4Abu] [Aeea] [Aeea] q R P [NMeArg] [Cha] S H K G [Oic] [Nle] [bAla] [D-BhPhe] {COOH} | 0.001096 | 0.00768 |
| 573 | {Palm} [AC4Abu] [Aeea] [Aeea] q R P [NMeArg] [Cha] S H K G [Oic] [Nle] [D-BhPhe] {COOH} | 0.002165 | 0.004245 |
| 575 | {Palm} [AC4Abu] [Aeea] [Aeea] q R P [NMeArg] [Cha] S H K G [Oic] [Nle] P [BhPhe] {COOH} | 0.003585 | 0.014095 |
| 577 | {Palm} [AC4Abu] [Aeea] [Aeea] q R P [NMeArg] [Cha] S H K G [Oic] [Nle] [Aib] [BhPhe] {COOH} | 0.001775 | 0.004425 |
| 578 | {Palm} [AC4Abu] [Aeea] [Aeea] q R P [NMeArg] [Cha] S H K G [Oic] [Nle] [BhPhe] {COOH} | 0.001805 | 0.004895 |
| 580 | {Palm} [AC4Abu] [Aeea] [Aeea] q R P [NMeArg] [Cha] S H K G [Oic] [Aib] [4-Cl-F] {COOH} | 0.0004615 | 0.0007365 |
| 584 | {Palm} [AC4Abu] [Aeea] [Aeea] q R P [NMeArg] [Cha] S H K G [Oic] [Nle] [1-Ach] [4-Cl-F] {COOH} | 0.0229 | 0.0522 |
| 585 | {Palm} [AC4Abu] [Aeea] [Aeea] q R P [NMeArg] [Cha] S H K G [Oic] [Nle] [Acp] [4-Cl-F] {COOH} | 0.006735 | 0.0223 |
| 586 | {Palm} [AC4Abu] [Aeea] [Aeea] q R P [NMeArg] [Cha] S H K G [Oic] [Nle] [Nip] [4-Cl-F] {COOH} | 0.007965 | 0.02295 |
| 587 | {Palm} [AC4Abu] [Aeea] [Aeea] q R P [NMeArg] [Cha] S H K G [Oic] [Nle] [Inp] [4-Cl-F] {COOH} | 0.001292 | 0.003585 |
| 600 | {Palm} [AC4Abu] [Aeea] [Aeea] q R P [NMeArg] [Cha] S H K G [Oic] [Nle] [BhPro] [D-4ClF] {COOH} | 0.001655 | 0.004455 |

TABLE 16-continued

| SEQ ID NO: | SEQUENCE | EC50 Human APJ Receptor (μM) | EC50 Rat APJ Receptor (μM) |
|---|---|---|---|
| APJ Agonist Activity of Modified Apelin Polypeptides | | | |
| 601 | {Palm} [AC4Abu] [Aeea] [Aeea] q R P [NMeArg] [Cha] S H K G [Oic] [Nle] [Pip] [D-4CIF] {COOH} | 0.003435 | 0.003255 |
| 602 | {Palm} [AC4Abu] [Aeea] [Aeea] q R P [NMeArg] [Cha] S H K G [Oic] [Nle] [Nip] [D-4CIF] {COOH} | 0.00548 | 0.02565 |
| 603 | {Palm} [AC4Abu] [Aeea] [Aeea] q R P [NMeArg] [Cha] S H K G [Oic] [Nle] [Inp] [D-4CIF] {COOH} | 0.002955 | 0.03235 |
| 604 | {Palm} [AC4Abu] [Aeea] [Aeea] q R P [NMeArg] [Cha] S H K G [Oic] [Nle] [Aib] [D-4CIF] {COOH} | 0.0004225 | 0.000512 |
| 606 | {Palm} [AC4Abu] [Aeea] [Aeea] q R P [NMeArg] [Cha] S H K G [Oic] [Nle] P [AMEF] {COOH} | 0.000307 | 0.00137 |
| 607 | {Palm} [AC4Abu] [Aeea] [Aeea] q R P [NMeArg] [Cha] S H K G [Oic] [Nle] P [D-AMF] {COOH} | 0.00009565 | 0.0005505 |
| 608 | {Palm} [AC4Abu] [Aeea] [Aeea] q R P [NMeArg] [Cha] S H K G [Oic] [Nle] [Aib] [AMEF] {COOH} | 0.0002135 | 0.0003255 |
| 609 | {Palm} [AC4Abu] [Aeea] [Aeea] q R P [NMeArg] [Cha] S H K G [Oic] [Nle] [Pip] [AMEF] {COOH} | 0.001245 | 0.002495 |
| 610 | {Palm} [AC4Abu] [Aeea] [Aeea] q R P [NMeArg] [Cha] S H K G [Oic] [Nle] [aMePro] [AMEF] {COOH} | 0.0010645 | 0.004985 |
| 611 | {Palm} [AC4Abu] [Aeea] [Aeea] q R P [NMeArg] [Cha] S H K G [Oic] [Nle] [BhPro] [AMEF] {COOH} | 0.000722 | 0.0015685 |
| 612 | {Palm} [AC4Abu] [Aeea] [Aeea] q R P [NMeArg] [Cha] S H K G [Oic] [Nle] [BhPro] [D-AMF] {COOH} | 0.00172 | 0.004625 |
| 617 | {Palm} [AC4Abu] [Aeea] [Aeea] q R P [NMeArg] [Cha] S h K G [Oic] [Nle] [BhPro] [D-BhPhe] {COOH} | 0.008675 | 0.0258 |
| 568 | {Palm} [AC4Abu] [Aeea] [Aeea] q R P [NMeArg] [Cha] S H K G [Pip] [Nle] P [D-BhPhe] {COOH} | 0.002965 | 0.004545 |
| 574 | {Palm} [AC4Abu] [Aeea] [Aeea] q R P [NMeArg] [Cha] S H K G [Pip] [Nle] [D-BhPhe] {COOH} | 0.0006525 | 0.00283 |
| 579 | {Palm} [AC4Abu] [Aeea] [Aeea] q R P [NMeArg] [Cha] S H K G [Pip] [Nle] [BhPhe] {COOH} | 0.000831 | 0.002505 |
| 581 | {Palm} [AC4Abu] [Aeea] [Aeea] q R P [NMeArg] [Cha] S H K G [Pip] [Aib] [4-Cl-F] {COOH} | 0.001401 | 0.00585 |
| 588 | {Palm} [AC4Abu] [Aeea] [Aeea] q R P [NMeArg] [Cha] S H K G [Pip] [Nle] [Nip] [4-Cl-F] {COOH} | 0.00152 | 0.00637 |
| 589 | {Palm} [AC4Abu] [Aeea] [Aeea] Q R P [NMeArg] [Cha] S H K G [Pip] [Nle] [Inp] [4-Cl-F] {COOH} | 0.000624 | 0.00415 |
| 590 | {Palm} [AC4Abu] [Aeea] [Aeea] q R P [NMeArg] [Cha] S H K G [Pip] [Nle] P [Aic] {COOH} | 0.000816 | 0.0062 |
| 597 | {Palm} [AC4Abu] [Aeea] [Aeea] q R P [NMeArg] [Cha] S H K G [Pip] [Nle] [Aic] {COOH} | 0.000885 | 0.00337 |
| 598 | {Palm} [AC4Abu] [Aeea] [Aeea] q R P [NMeArg] [Cha] S H K G [Pip] [Nle] P [Tic] {COOH} | 0.000463 | 0.002845 |

TABLE 16-continued

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 599 | {Palm} [AC4Abu] [Aeea] [Aeea] q R P [NMeArg] [Cha] S H K G [Pip] [Nle] P [D-Tic] {COOH} | 0.00044 | 0.001012 |
| 647 | {Palm} [AC4Abu] [Aeea] [Aeea] q R P [NMeArg] [Cha] S H K G [Pip] [Nle] P [BhPhe] {COOH} | 0.001579 | 0.00583 |
| 618 | {Palm} [AC4Abu] [Aeea] [Aeea] q R P [NMeArg] [Cha] S H O G [Oic] [Nle] [BhPro] [D-BhPhe] {COOH} | 0.002465 | 0.0111 |
| 593 | {Palm} [AC4Abu] [Aeea] [Aeea] Q R P [NMeArg] L S H K G P [Nle] P [4-Cl-F] {COOH} | 0.0001465 | 0.000231 |
| 645 | {Palm} [AC4Abu] [Aeea] [Aeea] q R P [NPipG] [Cha] S H K G [Pip] [Nle] [Aib] [4-Cl-F] {COOH} | 0.00025385 | 0.0003945 |
| 495 | {PDA} [AC4Abu] [Aeea] [Aeea] Q R P [NMeArg] L S H K G P [Nle] P [4-Cl-F] {COOH} | 0.00008295 | 0.0005325 |
| 118 | {pIFBu} [AC4Abu] [Aeea] [Aeea] Q R P [NMeArg] L S H K G P [Nle] P [4-Cl-F] {COOH} | 0.00004755 | 0.0001715 |
| 474 | {Sebacicacid} [AC4Abu] [Aeea] [Aeea] [hArg] Q [hArg] P [NMeArg] [Cha] S H K G [Oic] [Nle] P [4-Cl-F] {COOH} | 0.0011385 | 0.00376 |
| 291 | {Sebacicacid} [AC4Abu] [Aeea] [Aeea] [hArg] r Q [hArg] P r [NMeLeu] S H K G [Oic] [pI-Phe] P [D-Bip] {COOH} | 0.003375 | 0.00247 |
| 289 | {Sebacicacid} [AC4Abu] [Aeea] [Aeea] [hArg] r Q [hArg] P r [NMeLeu] S H K G [Oic] [pI-Phe] P [D-Bip] {COOH} | 0.000914 | 0.0013 |
| 288 | {Sebacicacid} [AC4Abu] [Aeea] [Aeea] Q [hArg] P r [NMeLeu] S H K G [Oic] [pI-Phe] P [D-Bip] {COOH} | 0.03855 | 0.0385 |
| 509 | {Sebacicacid} [AC4Abu] [Aeea] [Aeea] Q R P [NMeArg] L S H K G P [Nle] P [4-Cl-F] {COOH} | 0.000179 | 0.0008645 |
| 594 | {St} [AC4Abu] [Aeea] [Aeea] Q R P [NMeArg] L S H K G P [Nle] P [4-Cl-F] {COOH} | 0.0002455 | 0.000528 |
| 508 | {Subericacid} [AC4Abu] [Aeea] [Aeea] Q R P [NMeArg] L S H K G P [Nle] P [4-Cl-F] {COOH} | 0.0000768 | 0.0004665 |
| 497 | {Succinicacid} [AC4Abu] [Aeea] [Aeea] Q R P [NMeArg] L S H K G P [Nle] P [4-Cl-F] {COOH} | 0.000208 | 0.0013918 |
| 534 | {TDA} [AC4Abu] [AC4Abu] [Aeea] [Aeea] q R P [NMeArg] [Cha] S H K G [Oic] [Nle] [Aib] [4-Cl-F] {COOH} | 0.000683 | 0.00375 |
| 399 | {TDA} [AC4Abu] [AC4Abu] [Aeea] [Aeea] Q R P [NMeArg] L S H K G P [Nle] P [4-Cl-F] {COOH} | 0.0000335 | 0.0001044 |
| 535 | {TDA} [AC4Abu] [AC4Abu] [Aeea] q R P [NMeArg] [Cha] S H K G [Oic] [Nle] [Aib] [4-Cl-F] {COOH} | 0.000798 | 0.005145 |
| 462 | {TDA} [AC4Abu] [AC4Abu] [Aeea] Q R P [NMeArg] L S H K G P [Nle] P [4-Cl-F] {COOH} | 0.0000154 | 0.00007925 |
| 533 | {TDA} [AC4Abu] [AC4Abu] q R P [NMeArg] [Cha] S H K G [Oic] [Nle] [Aib] [4-Cl-F] {COOH} | 0.000629 | 0.003875 |
| 536 | {TDA} [AC4Abu] [Aeea] [AC4Abu] q R P [NMeArg] [Cha] S H K G [Oic] [Nle] [Aib] [4-Cl-F] {COOH} | 0.000592 | 0.00203 |

TABLE 16-continued

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 398 | {TDA} [AC4Abu] [Aeea] [Aeea] [Aeea] [Aeea] [Aeea] [Aeea] Q R P [NMeArg] L S H K G P [Nle] P [4-Cl-F] {COOH} | 0.00005735 | 0.0001163 |
| 375 | {TDA} [AC4Abu] [Aeea] [Aeea] [aMeLeu] R P [NMeArg] [aMeLeu] S H K G [Oic] [Nle] P [4-Cl-F] {COOH} | 0.00015535 | 0.000288 |
| 299 | {TDA} [AC4Abu] [Aeea] [Aeea] [BhAsn] [hArg] P [NMeArg] [Cha] S H K G [Oic] [Nle] P [D-4CIF] {COOH} | 0.02435 | 0.0146 |
| 420 | {TDA} [AC4Abu] [Aeea] [Aeea] [BhAsn] R P [NMeArg] L S H K G P [Nle] P [4-Cl-F] {COOH} | 0.00005255 | 0.0000838 |
| 463 | {TDA} [AC4Abu] [Aeea] [Aeea] [BhGln] R P [NMeArg] L S H K G P [Nle] P [4-Cl-F] {COOH} | 0.00002005 | 0.0001275 |
| 300 | {TDA} [AC4Abu] [Aeea] [Aeea] [BhLeu] [hArg] P [NMeArg] [Cha] S H K G [Oic] [Nle] P [D-4CIF] {COOH} | 0.0415 | 0.03635 |
| 421 | {TDA} [AC4Abu] [Aeea] [Aeea] [BhLeu] R P [NMeArg] L S H K G P [Nle] P [4-Cl-F] {COOH} | 0.0000934 | 0.0002855 |
| 298 | {TDA} [AC4Abu] [Aeea] [Aeea] [BLeu] [hArg] P [NMeArg] [Cha] S H K G [Oic] [Nle] P [D-4CIF] {COOH} | 0.03285 | 0.0249 |
| 552 | {TDA} [AC4Abu] [Aeea] [Aeea] [BLeu] R [aMePro] [hArg] [aMeLeu] S H K G [Oic] [Nle] [aMePro] [4-Cl-F] {COOH} | 0.001955 | 0.0048775 |
| 395 | {TDA} [AC4Abu] [Aeea] [Aeea] [BLeu] R P [hArg] [BLeu] S H K G [Oic] [Nle] P [4-Cl-F] {COOH} | 0.000741 | 0.00102 |
| 374 | {TDA} [AC4Abu] [Aeea] [Aeea] [BLeu] R P [NMeArg] [aMeLeu] S H K G [Oic] [Nle] P [4-Cl-F] {COOH} | 0.00030537 | 0.00050275 |
| 388 | {TDA} [AC4Abu] [Aeea] [Aeea] [BLeu] R P [NMeArg] [aMeLeu] S H K G [Oic] [Nle] [aMePro] [4-Cl-F] {COOH} | 0.000706 | 0.0007275 |
| 394 | {TDA} [AC4Abu] [Aeea] [Aeea] [BLeu] R P [NMeArg] [BLeu] S H K G [Oic] [Nle] P [4-Cl-F] {COOH} | 0.000297 | 0.001498 |
| 393 | {TDA} [AC4Abu] [Aeea] [Aeea] [BLeu] R P [NMeArg] [Cha] S H K G [Oic] [Nle] P [4-Cl-F] {COOH} | 0.000769 | 0.002665 |
| 558 | {TDA} [AC4Abu] [Aeea] [Aeea] [Deg] [hArg] P r [Cha] S H K G [Oic] [Nle] P [4-Cl-F] {COOH} | 0.0034 | 0.01249 |
| 443 | {TDA} [AC4Abu] [Aeea] [Aeea] [Deg] R P [NMeArg] [Cha] S H K G [Oic] [Nle] P [4-Cl-F] {COOH} | 0.00231 | 0.00167 |
| 309 | {TDA} [AC4Abu] [Aeea] [Aeea] [hArg] [hArg] Q [hArg] P [NMeArg] [Cha] S H K G [Oic] [Nle] P [4-Cl-F] {COOH} | 0.000181 | 0.0002155 |
| 321 | {TDA} [AC4Abu] [Aeea] [Aeea] [hArg] [Nle] Q [hArg] P r [NMeLeu] A H K G [Oic] [pI-Phe] P [D-Bip] {COOH} | 0.0179 | 0.02905 |

TABLE 16-continued

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 333 | {TDA} [AC4Abu] [Aeea] [Aeea] [hArg] [Nle] Q [hArg] P r [NMeLeu] A A K G [Oic] [pI-Phe] P [D-Bip] {COOH} | 0.0361 | 0.04665 |
| 315 | {TDA} [AC4Abu] [Aeea] [Aeea] [hArg] [Nle] Q [hArg] P r [NMeLeu] S H K G [Oic] [pI-Phe] P [D-Bip] {COOH} | 0.003045 | 0.0049 |
| 327 | {TDA} [AC4Abu] [Aeea] [Aeea] [hArg] [Nle] Q [hArg] P r [NMeLeu] S A K G [Oic] [pI-Phe] P [D-Bip] {COOH} | 0.014445 | 0.014805 |
| 490 | {TDA} [AC4Abu] [Aeea] [Aeea] [hArg] Q [hArg] P [hArg] [Cha] S H K G [Oic] [Nle] P [4-Cl-F] {COOH} | 0.00002765 | 0.0001015 |
| 310 | {TDA} [AC4Abu] [Aeea] [Aeea] [hArg] Q [hArg] P [NMeArg] [Cha] S H K G [Oic] [Nle] P [4-Cl-F] {COOH} | 0.000226 | 0.0003635 |
| 317 | {TDA} [AC4Abu] [Aeea] [Aeea] [hArg] r Q [hArg] P [Nle] [NMeLeu] A H K G [Oic] [pI-Phe] P [D-Bip] {COOH} | 0.05685 | 0.0639 |
| 329 | {TDA} [AC4Abu] [Aeea] [Aeea] [hArg] r Q [hArg] P [Nle] [NMeLeu] A A K G [Oic] [pI-Phe] P [D-Bip] {COOH} | 0.03755 | 0.03615 |
| 311 | {TDA} [AC4Abu] [Aeea] [Aeea] [hArg] r Q [hArg] P [Nle] [NMeLeu] S H K G [Oic] [pI-Phe] P [D-Bip] {COOH} | 0.0347 | 0.03735 |
| 323 | {TDA} [AC4Abu] [Aeea] [Aeea] [hArg] r Q [hArg] P [Nle] [NMeLeu] S A K G [Oic] [pI-Phe] P [D-Bip] {COOH} | 0.0025055 | 0.005295 |
| 331 | {TDA} [AC4Abu] [Aeea] [Aeea] [hArg] r Q [hArg] P K [NMeLeu] A A [Nle] G [Oic] [pI-Phe] P [D-Bip] {COOH} | 0.0247 | 0.01805 |
| 319 | {TDA} [AC4Abu] [Aeea] [Aeea] [hArg] r Q [hArg] P K [NMeLeu] A H [Nle] G [Oic] [pI-Phe] P [D-Bip] {COOH} | 0.07325 | 0.0631 |
| 325 | {TDA} [AC4Abu] [Aeea] [Aeea] [hArg] r Q [hArg] P K [NMeLeu] S A [Nle] G [Oic] [pI-Phe] P [D-Bip] {COOH} | 0.003955 | 0.00476 |
| 313 | {TDA} [AC4Abu] [Aeea] [Aeea] [hArg] r Q [hArg] P K [NMeLeu] S H [Nle] G [Oic] [pI-Phe] P [D-Bip] {COOH} | 0.01475 | 0.010445 |
| 330 | {TDA} [AC4Abu] [Aeea] [Aeea] [hArg] r Q [hArg] P r [NMeLeu] A A [Nle] G [Oic] [pI-Phe] P [D-Bip] {COOH} | 0.0397 | 0.05605 |
| 318 | {TDA} [AC4Abu] [Aeea] [Aeea] [hArg] r Q [hArg] P r [NMeLeu] A H [Nle] G [Oic] [pI-Phe] P [D-Bip] {COOH} | 0.00744 | 0.04595 |
| 324 | {TDA} [AC4Abu] [Aeea] [Aeea] [hArg] r Q [hArg] P r [NMeLeu] S A [Nle] G [Oic] [pI-Phe] P [D-Bip] {COOH} | 0.014865 | 0.02035 |
| 312 | {TDA} [AC4Abu] [Aeea] [Aeea] [hArg] r Q [hArg] P r [NMeLeu] S H [Nle] G [Oic] [pI-Phe] P [D-Bip] {COOH} | 0.013575 | 0.01063 |
| 334 | {TDA} [AC4Abu] [Aeea] [Aeea] [hArg] r Q [Nle] P r [NMeLeu] A A K G [Oic] [pI-Phe] P [D-Bip] {COOH} | 0.03415 | 0.0447 |

TABLE 16-continued

| SEQ ID NO: | SEQUENCE | EC50 Human APJ Receptor (μM) | EC50 Rat APJ Receptor (μM) |
|---|---|---|---|
| APJ Agonist Activity of Modified Apelin Polypeptides | | | |
| 322 | {TDA} [AC4Abu] [Aeea] [Aeea] [hArg] r Q [Nle] P r [NMeLeu] A H K G [Oic] [pI-Phe] P [D-Bip] {COOH} | 0.0163 | 0.02645 |
| 328 | {TDA} [AC4Abu] [Aeea] [Aeea] [hArg] r Q [Nle] P r [NMeLeu] S A K G [Oic] [pI-Phe] P [D-Bip] {COOH} | 0.00917 | 0.0077 |
| 316 | {TDA} [AC4Abu] [Aeea] [Aeea] [hArg] r Q [Nle] P r [NMeLeu] S H K G [Oic] [pI-Phe] P [D-Bip] {COOH} | 0.006005 | 0.009295 |
| 347 | {TDA} [AC4Abu] [Aeea] [Aeea] [Nle] Q R P [hArg] [Cha] A A K G [Oic] [Nle] P [4-Cl-F] {COOH} | 0.001885 | 0.00213 |
| 342 | {TDA} [AC4Abu] [Aeea] [Aeea] [Nle] Q R P [hArg] [Cha] S A K G [Oic] [Nle] P [4-Cl-F] {COOH} | 0.0008035 | 0.0006845 |
| 338 | {TDA} [AC4Abu] [Aeea] [Aeea] [Nle] Q R P [hArg] [Cha] S H K G [Oic] [Nle] P [4-Cl-F] {COOH} | 0.00056 | 0.000766 |
| 332 | {TDA} [AC4Abu] [Aeea] [Aeea] [Nle] r Q [hArg] P r [NMeLeu] A A K G [Oic] [pI-Phe] P [D-Bip] {COOH} | 0.03995 | 0.05055 |
| 320 | {TDA} [AC4Abu] [Aeea] [Aeea] [Nle] r Q [hArg] P r [NMeLeu] A H K G [Oic] [pI-Phe] P [D-Bip] {COOH} | 0.01785 | 0.03765 |
| 326 | {TDA} [AC4Abu] [Aeea] [Aeea] [Nle] r Q [hArg] P r [NMeLeu] S A K G [Oic] [pI-Phe] P [D-Bip] {COOH} | 0.014765 | 0.01777 |
| 314 | {TDA} [AC4Abu] [Aeea] [Aeea] [Nle] r Q [hArg] P r [NMeLeu] S H K G [Oic] [pI-Phe] P [D-Bip] {COOH} | 0.00277 | 0.006815 |
| 557 | {TDA} [AC4Abu] [Aeea] [Aeea] [Tle] [hArg] P r [Cha] SH K G [Oic] [Nle] P [4-Cl-F] {COOH} | 0.00612 | 0.010425 |
| 442 | {TDA} [AC4Abu] [Aeea] [Aeea] [Tle] R P [NMeArg] [Cha] S H K G [Oic] [Nle] P [4-Cl-F] {COOH} | 0.002005 | 0.00216 |
| 292 | {TDA} [AC4Abu] [Aeea] [Aeea] 1 [hArg] P [NMeArg] [Cha] S H K G [Oic] [Nle] P [D-4ClF] {COOH} | 0.00578 | 0.006675 |
| 307 | {TDA} [AC4Abu] [Aeea] [Aeea] O F [hArg] [hArg] [BLeu] [hArg] P [hArg] [Cha] S H K G [Oic] [Nle] P [4-Cl-F] {COOH} | 0.000305 | 0.0003105 |
| 297 | {TDA} [AC4Abu] [Aeea] [Aeea] O F [hArg] [hArg] Q [NMeArg] P [NMeArg] [Cha] S H K G [Oic] [Nle] P [4-Cl-F] {COOH} | 0.0006975 | 0.0010165 |
| 550 | {TDA} [AC4Abu] [Aeea] [Aeea] Q [BhPro] [NMeArg] [Cha] S H K G [Oic] [Nle] [Aib] [4-Cl-F] {COOH} | 0.0948 | 0.13525 |
| 400 | {TDA} [AC4Abu] [Aeea] [Aeea] Q [Cit] P [NMeArg] L S H K G P [Nle] P [4-Cl-F] {COOH} | 0.00009275 | 0.00042 |

TABLE 16-continued

| SEQ ID NO: | SEQUENCE | EC50 Human APJ Receptor (μM) | EC50 Rat APJ Receptor (μM) |
|---|---|---|---|
| | APJ Agonist Activity of Modified Apelin Polypeptides | | |
| 454 | {TDA} [AC4Abu] [Aeea] [Aeea] q [hArg] [Aib] r [Cha] S H K G [Oic] [Nle] P [4-Cl-F] {COOH} | 0.001072 | 0.00535 |
| 301 | {TDA} [AC4Abu] [Aeea] [Aeea] q [hArg] [BhPro] [NMeArg] [Cha] S H K G [Oic] [Nle] P [D-4ClF] {COOH} | 0.03595 | 0.029 |
| 455 | {TDA} [AC4Abu] [Aeea] [Aeea] q [hArg] [Deg] r [Cha] S H K G [Oic] [Nle] P [4-Cl-F] {COOH} | 0.002475 | 0.010265 |
| 486 | {TDA} [AC4Abu] [Aeea] [Aeea] q [hArg] [Oic] r [Cha] S H K G [Oic] [Nle] P [4-Cl-F] {COOH} | 0.001795 | 0.00404 |
| 488 | {TDA} [AC4Abu] [Aeea] [Aeea] q [hArg] P [hArg] [Cha] S H K G [Oic] [Nle] P [4-Cl-F] {COOH} | 0.0001975 | 0.001725 |
| 489 | {TDA} [AC4Abu] [Aeea] [Aeea] Q [hArg] P [hArg] [Cha] S H K G [Oic] [Nle] P [4-Cl-F] {COOH} | 0.00060125 | 0.00359 |
| 358 | {TDA} [AC4Abu] [Aeea] [Aeea] Q [hArg] P [hArg] L S H K G [Oic] [Nle] P [4-Cl-F] {COOH} | 0.000285 | 0.00031433 |
| 357 | {TDA} [AC4Abu] [Aeea] [Aeea] Q [hArg] P [hArg] L S H K G P [Nle] P [4-Cl-F] {COOH} | 0.000073 | 0.00023967 |
| 359 | {TDA} [AC4Abu] [Aeea] [Aeea] Q [hArg] P [NMeArg] [aMeLeu] S H K G [Oic] [Nle] P [4-Cl-F] {COOH} | 0.00005295 | 0.000116 |
| 460 | {TDA} [AC4Abu] [Aeea] [Aeea] Q [hArg] P [NMeArg] [aMeLeu] S H K G P [Nle] P [4-Cl-F] {COOH} | 0.0000347 | 0.00006275 |
| 473 | {TDA} [AC4Abu] [Aeea] [Aeea] Q [hArg] P [NMeArg] [aMeLeu] S H K G P [Nle] P [2Nal] {COOH} | 0.00009905 | 0.000465 |
| 302 | {TDA} [AC4Abu] [Aeea] [Aeea] q [hArg] P [NMeArg] [BhLeu] S H K G [Oic] [Nle] P [D-4ClF] {COOH} | 0.016495 | 0.01435 |
| 383 | {TDA} [AC4Abu] [Aeea] [Aeea] Q [hArg] P [NMeArg] [BLeu] S H K G P [Nle] P [4-Cl-F] {COOH} | 0.000535 | 0.0013695 |
| 303 | {TDA} [AC4Abu] [Aeea] [Aeea] q [hArg] P [NMeArg] [Cha] [bAla] H K G [Oic] [Nle] P [D-4ClF] {COOH} | 0.0792 | 0.07415 |
| 304 | {TDA} [AC4Abu] [Aeea] [Aeea] q [hArg] P [NMeArg] [Cha] S [bAla] K G [Oic] [Nle] P [D-4ClF] {COOH} | 0.1394 | 0.2605 |
| 305 | {TDA} [AC4Abu] [Aeea] [Aeea] q [hArg] P [NMeArg] [Cha] S H [3Pal] G [Oic] [Nle] P [D-4ClF] {COOH} | 0.078 | 0.06665 |
| 293 | {TDA} [AC4Abu] [Aeea] [Aeea] q [hArg] P [NMeArg] [Cha] S H [bAla] G [Oic] [Nle] P [D-4ClF] {COOH} | 0.10915 | 0.11 |
| 306 | {TDA} [AC4Abu] [Aeea] [Aeea] q [hArg] P [NMeArg] [Cha] S H [BLys] G [Oic] [Nle] P [D-4ClF] {COOH} | 0.07405 | 0.1365 |

TABLE 16-continued

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 294 | {TDA} [AC4Abu] [Aeea] [Aeea] q [hArg] P [NMeArg] [Cha] S H K [bAla] [Oic] [Nle] P [D-4ClF] {COOH} | >4.17 [2] | 0.0307 |
| 295 | {TDA} [AC4Abu] [Aeea] [Aeea] q [hArg] P [NMeArg] [Cha] S H K G [Oic] [Nle] [bAla] [D-4ClF] {COOH} | 0.00329 | 0.01039 |
| 296 | {TDA} [AC4Abu] [Aeea] [Aeea] q [hArg] P [NMeArg] [Cha] S H K G [Oic] [Nle] [BhPro] [D-4ClF] {COOH} | 0.002745 | 0.00232 |
| 362 | {TDA} [AC4Abu] [Aeea] [Aeea] Q [hArg] P [NMeArg] [Cha] S H K G [Oic] [Nle] P [4-Cl-F] {COOH} | 0.00197 | 0.0037522 |
| 405 | {TDA} [AC4Abu] [Aeea] [Aeea] Q [hArg] P [NMeArg] [Cha] S H K G [Oic] [Nle] P [2Nal] {COOH} | 0.005755 | 0.013845 |
| 478 | {TDA} [AC4Abu] [Aeea] [Aeea] q [hArg] P [NMeArg] [Cha] S H K G [Oic] [Nle] P [4-Cl-F] {COOH} | 0.000496 | 0.0008075 |
| 408 | {TDA} [AC4Abu] [Aeea] [Aeea] Q [hArg] P [NMeArg] [Cha] S H K G P [Nle] P [4-Cl-F] {COOH} | 0.0000768 | 0.0001841 |
| 354 | {TDA} [AC4Abu] [Aeea] [Aeea] Q [hArg] P [NMeArg] L S H K G [Oic] [Nle] P [4-Cl-F] {COOH} | 0.000279 | 0.0003615 |
| 353 | {TDA} [AC4Abu] [Aeea] [Aeea] Q [hArg] P [NMeArg] L S H K G P [Nle] P [4-Cl-F] {COOH} | 0.000095 | 0.00027467 |
| 483 | {TDA} [AC4Abu] [Aeea] [Aeea] Q [hArg] P [NMehArg] L S H K G P [Nle] P [4-Cl-F] {COOH} | 0.0000754 | 0.000229 |
| 451 | {TDA} [AC4Abu] [Aeea] [Aeea] q [hArg] P r [Cha] S [Deg] K G [Oic] [Nle] P [4-Cl-F] {COOH} | 0.0112 | 0.03165 |
| 452 | {TDA} [AC4Abu] [Aeea] [Aeea] q [hArg] P r [Cha] S [Tle] K G [Oic] [Nle] P [4-Cl-F] {COOH} | 0.01044 | 0.025 |
| 372 | {TDA} [AC4Abu] [Aeea] [Aeea] q [hArg] P r [Cha] S A K G [Oic] [Nle] P [4-Cl-F] {COOH} | 0.00284 | 0.001495 |
| 371 | {TDA} [AC4Abu] [Aeea] [Aeea] q [hArg] P r [Cha] S H K [Tle] [Oic] [Nle] P [4-Cl-F] {COOH} | 0.00692 | 0.00467 |
| 363 | {TDA} [AC4Abu] [Aeea] [Aeea] q [hArg] P r [Cha] S H K G [Oic] [Nle] P [4-Cl-F] {COOH} | 0.00327 | 0.003955 |
| 364 | {TDA} [AC4Abu] [Aeea] [Aeea] Q [hArg] P r [Cha] S H K G [Oic] [Nle] P [D-4ClF] {COOH} | 0.006 | 0.02035 |
| 365 | {TDA} [AC4Abu] [Aeea] [Aeea] q [hArg] P r [Cha] S H K G [Oic] [Nle] P [Oic] {COOH} | 0.023 | 0.02065 |
| 366 | {TDA} [AC4Abu] [Aeea] [Aeea] q [hArg] P r [Cha] S H K G [Oic] [Nle] P [Aic] {COOH} | 0.01715 | 0.0236 |

TABLE 16-continued

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 367 | {TDA} [AC4Abu] [Aeea] [Aeea] q [hArg] P r [Cha] S H K G [Oic] [Nle] P [1-Nal] {COOH} | 0.02635 | 0.0675 |
| 368 | {TDA} [AC4Abu] [Aeea] [Aeea] q [hArg] P r [Cha] S H K G [Oic] [Nle] P [2-Nal] {COOH} | 0.0323 | 0.03135 |
| 369 | {TDA} [AC4Abu] [Aeea] [Aeea] q [hArg] P r [Cha] S H K G [Oic] [Nle] P [D-4IF] {COOH} | 0.0259 | 0.04205 |
| 370 | {TDA} [AC4Abu] [Aeea] [Aeea] q [hArg] P r [Cha] S H K G [Oic] [Nle] P [Bh4ClF] {COOH} | 0.01291 | 0.0237 |
| 406 | {TDA} [AC4Abu] [Aeea] [Aeea] q [hArg] P r [Cha] S H K G [Oic] [Nle] P [CPG] {COOH} | 0.03355 | 0.07295 |
| 407 | {TDA} [AC4Abu] [Aeea] [Aeea] q [hArg] P r [Cha] S H K G [Oic] [Nle] P [D-2Nal] {COOH} | 0.12395 | 0.216 |
| 431 | {TDA} [AC4Abu] [Aeea] [Aeea] q [hArg] P r [Cha] S H K G [Oic] [Nle] P [D-Igl] {COOH} | 0.03125 | 0.025 |
| 432 | {TDA} [AC4Abu] [Aeea] [Aeea] q [hArg] P r [Cha] S H K G [Oic] [Nle] P [B4ClF] {COOH} | 0.01105 | 0.01615 |
| 453 | {TDA} [AC4Abu] [Aeea] [Aeea] q [hArg] P r [Cha] S H K G [Oic] [Nle] [D-4IF] {COOH} | 0.01895 | 0.0208 |
| 595 | {TDA} [AC4Abu] [Aeea] [Aeea] q [hArg] P r [Cha] S H K G [Oic] [Nle] [Aic] {COOH} | 0.05005 | 0.05475 |
| 596 | {TDA} [AC4Abu] [Aeea] [Aeea] q [hArg] P r [Cha] S H K G [Oic] [Nle] [Oic] {COOH} | 0.005135 | 0.0339 |
| 373 | {TDA} [AC4Abu] [Aeea] [Aeea] q [hArg] P r [Cha] S Y K G [Oic] [Nle] P [4-Cl-F] {COOH} | 0.00281 | 0.003315 |
| 434 | {TDA} [AC4Abu] [Aeea] [Aeea] q [hArg] P r [Deg] S H K G [Oic] [Nle] P [4-Cl-F] {COOH} | 0.010995 | 0.011405 |
| 433 | {TDA} [AC4Abu] [Aeea] [Aeea] q [hArg] P r [Tle] S H K G [Oic] [Nle] P [4-Cl-F] {COOH} | 0.01285 | 0.01975 |
| 397 | {TDA} [AC4Abu] [Aeea] [Aeea] Q [NMeArg] [aMeLeu] S H K G [Oic] [Nle] P [4-Cl-F] {COOH} | 0.00636 | 0.016515 |
| 484 | {TDA} [AC4Abu] [Aeea] [Aeea] Q [NMehArg] P [NMeArg] [aMeLeu] S H K G P [Nle] P [4-Cl-F] {COOH} | 0.000176 | 0.000767 |
| 524 | {TDA} [AC4Abu] [Aeea] [Aeea] q E P [NMeArg] [Cha] S H K G [Oic] [Nle] [Aib] [4-Cl-F] {COOH} | 0.05315 | 0.346 |
| 525 | {TDA} [AC4Abu] [Aeea] [Aeea] q e P [NMeArg] [Cha] S H K G [Oic] [Nle] [Aib] [4-Cl-F] {COOH} | 0.1585 | 0.243 |

TABLE 16-continued

| APJ Agonist Activity of Modified Apelin Polypeptides | | | |
|---|---|---|---|
| SEQ ID NO: | SEQUENCE | EC50 Human APJ Receptor (μM) | EC50 Rat APJ Receptor (μM) |
| 475 | {TDA} [AC4Abu] [Aeea] [Aeea] Q E P [NMeArg] L S H K G P [Nle] P [4-Cl-F] {COOH} | 0.010345 | 0.03585 |
| 520 | {TDA} [AC4Abu] [Aeea] [Aeea] Q P [NMeArg] [Cha] S H K G [Oic] [Nle] [Aib] [4-Cl-F] {COOH} | 0.009175 | 0.05615 |
| 482 | {TDA} [AC4Abu] [Aeea] [Aeea] Q R [aMePro] [hArg] [aMeLeu] S H K G P [Nle] P [4-Cl-F] {COOH} | 0.00008625 | 0.00020283 |
| 392 | {TDA} [AC4Abu] [Aeea] [Aeea] Q R [aMePro] [hArg] [BLeu] S H K G [Oic] [Nle] P [4-Cl-F] {COOH} | 0.0005845 | 0.0008555 |
| 501 | {TDA} [AC4Abu] [Aeea] [Aeea] q R [aMePro] [hArg] [BLeu] S H K G [Pip] [Nle] [4-Cl-F] {COOH} | 0.010927 | 0.068175 |
| 502 | {TDA} [AC4Abu] [Aeea] [Aeea] q R [aMePro] [hArg] [BLeu] S H K G [Oic] [Nle] [aMePro] [4-Cl-F] {COOH} | 0.00045625 | 0.004815 |
| 503 | {TDA} [AC4Abu] [Aeea] [Aeea] q R [aMePro] [hArg] [BLeu] S H K G [Pip] [Nle] [aMePro] [4-Cl-F] {COOH} | 0.00016 | 0.002125 |
| 504 | {TDA} [AC4Abu] [Aeea] [Aeea] q R [aMePro] [hArg] [BLeu] S H K G [aMePro] [Nle] [aMePro] [4-Cl-F] {COOH} | 0.001394 | 0.023075 |
| 505 | {TDA} [AC4Abu] [Aeea] [Aeea] q R [aMePro] [hArg] [BLeu] S H K G [Oic] [Nle] [Aib] [4-Cl-F] {COOH} | 0.00007075 | 0.000516 |
| 519 | {TDA} [AC4Abu] [Aeea] [Aeea] q R [aMePro] [hArg] [BLeu] S H K G [Oic] [Nle] [4-Cl-F] {COOH} | 0.009735 | 0.0447 |
| 556 | {TDA} [AC4Abu] [Aeea] [Aeea] q R [aMePro] [hArg] [BLeu] S H K G [Oic] [Nle] [BhPro] [4-Cl-F] {COOH} | 0.018 | 0.0691 |
| 523 | {TDA} [AC4Abu] [Aeea] [Aeea] q R [aMePro] [Nle] [BLeu] S H K G [Oic] [Nle] [aMePro] [4-Cl-F] {COOH} | 0.02565 | 0.0719 |
| 522 | {TDA} [AC4Abu] [Aeea] [Aeea] q R [BhPro] [hArg] [BLeu] S H K G [Oic] [Nle] [Aib] [4-Cl-F] {COOH} | 0.000523 | 0.006765 |
| 553 | {TDA} [AC4Abu] [Aeea] [Aeea] q R [BhPro] [NMeArg] [aMeLeu] S H K G [Oic] [Nle] [aMePro] [4-Cl-F] {COOH} | 0.002227 | 0.00201 |
| 441 | {TDA} [AC4Abu] [Aeea] [Aeea] Q R [BhPro] [NMeArg] [Cha] S H K G [Oic] [Nle] P [4-Cl-F] {COOH} | 0.001895 | 0.001815 |
| 516 | {TDA} [AC4Abu] [Aeea] [Aeea] q R [BhPro] [NMeArg] [Cha] S H K G [Oic] [Nle] [Aib] [4-Cl-F] {COOH} | 0.000557 | 0.0020225 |
| 396 | {TDA} [AC4Abu] [Aeea] [Aeea] Q R [NMeArg] [aMeLeu] S H K G [Oic] [Nle] P [4-Cl-F] {COOH} | 0.0009765 | 0.00114 |
| 447 | {TDA} [AC4Abu] [Aeea] [Aeea] Q R [NMeArg] [BLeu] S H K G [Oic] [Nle] P [4-Cl-F] {COOH} | 0.00966 | 0.014805 |

TABLE 16-continued

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 446 | {TDA} [AC4Abu] [Aeea] [Aeea] Q R [NMeArg] [Cha] S H K G [Oic] [Nle] P [4-Cl-F] {COOH} | 0.0011105 | 0.001895 |
| 521 | {TDA} [AC4Abu] [Aeea] [Aeea] q R [Pip] [hArg] [BLeu] S H K G [Oic] [Nle] [Aib] [4-Cl-F] {COOH} | 0.0010255 | 0.0032075 |
| 440 | {TDA} [AC4Abu] [Aeea] [Aeea] Q R [Pip] [NMeArg] [Cha] S H K G [Oic] [Nle] P [4-Cl-F] {COOH} | 0.003485 | 0.004265 |
| 517 | {TDA} [AC4Abu] [Aeea] [Aeea] q R [Pip] [NMeArg] [Cha] S H K G [Oic] [Nle] [Aib] [4-Cl-F] {COOH} | 0.00062 | 0.0032225 |
| 476 | {TDA} [AC4Abu] [Aeea] [Aeea] Q R E [NMeArg] L S H K G P [Nle] P [4-Cl-F] {COOH} | 0.000346 | 0.0008725 |
| 360 | {TDA} [AC4Abu] [Aeea] [Aeea] Q R P [hArg] [aMeLeu] SH K G [Oic] [Nle] P [4-Cl-F] {COOH} | 0.0000519 | 0.000082733 |
| 404 | {TDA} [AC4Abu] [Aeea] [Aeea] Q R P [hArg] [aMeLeu] S H K G P [Nle] P [2Nal] {COOH} | 0.000298 | 0.0003615 |
| 485 | {TDA} [AC4Abu] [Aeea] [Aeea] Q r P [hArg] [aMeLeu] SH K G P [Nle] P [4-Cl-F] {COOH} | 0.00011305 | 0.00041 |
| 378 | {TDA} [AC4Abu] [Aeea] [Aeea] q R P [hArg] [BLeu] S H K G [Oic] [Nle] P [4-Cl-F] {COOH} | 0.00025955 | 0.0004115 |
| 308 | {TDA} [AC4Abu] [Aeea] [Aeea] Q R P [hArg] [Cha] S H K G [Oic] [Nle] P [4-Cl-F] {COOH} | 0.00008665 | 0.00018 |
| 356 | {TDA} [AC4Abu] [Aeea] [Aeea] Q R P [hArg] L S H K G [Oic] [Nle] P [4-Cl-F] {COOH} | 0.0003205 | 0.00028933 |
| 355 | {TDA} [AC4Abu] [Aeea] [Aeea] Q R P [hArg] L S H K G P [Nle] P 4-Cl-F] {COOH} | 0.00002445 | 0.00006 |
| 529 | {TDA} [AC4Abu] [Aeea] [Aeea] q R P [Nle] [Cha] S A K G [Oic] [Nle] [Aib] [4-Cl-F] {COOH} | 0.00526 | 0.024 |
| 528 | {TDA} [AC4Abu] [Aeea] [Aeea] q R P [Nle] [Cha] S H K G [Oic] [Nle] [Aib] [4-Cl-F] {COOH} | 0.0056325 | 0.021825 |
| 428 | {TDA} [AC4Abu] [Aeea] [Aeea] Q R P [Nle] L S H K G P [Nle] P [4-Cl-F] {COOH} | 0.0004005 | 0.000494 |
| 518 | {TDA} [AC4Abu] [Aeea] [Aeea] q R P [NMeArg] [aMeLeu] [BhSer] H K G [Oic] [Nle] [aMePro] [4-Cl-F] {COOH} | 0.00011295 | 0.000444 |
| 387 | {TDA} [AC4Abu] [Aeea] [Aeea] Q R P [NMeArg] [aMeLeu] S H K G [aMePro] [Nle] P [4-Cl-F] {COOH} | 0.00010873 | 0.00016625 |
| 376 | {TDA} [AC4Abu] [Aeea] [Aeea] Q R P [NMeArg] [aMeLeu] S H K G [Oic] [Nle] [aMePro] [4-Cl-F] {COOH} | 0.0002375 | 0.0004145 |

TABLE 16-continued

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 385 | {TDA} [AC4Abu] [Aeea] [Aeea] Q R P [NMeArg] [aMeLeu] S H K G [Oic] [Nle] P [4-Cl-F] {COOH} | 0.00006875 | 0.0001705 |
| 386 | {TDA} [AC4Abu] [Aeea] [Aeea] q R P [NMeArg] [aMeLeu] S H K G [Oic] [Nle] P [4-Cl-F] {COOH} | 0.0000934 | 0.00026113 |
| 389 | {TDA} [AC4Abu] [Aeea] [Aeea] Q R P [NMeArg] [aMeLeu] S H K G [Oic] [Nle] [4-Cl-F] {COOH} | 0.00019648 | 0.00036525 |
| 554 | {TDA} [AC4Abu] [Aeea] [Aeea] q R P [NMeArg] [aMeLeu] S H K G [Oic] [Nle] [BhPro] [4-Cl-F] {COOH} | 0.000867 | 0.0028325 |
| 555 | {TDA} [AC4Abu] [Aeea] [Aeea] q R P [NMeArg] [aMeLeu] S H K G [Pip] [Nle] [aMePro] [4-Cl-F] {COOH} | 0.0001024 | 0.0004215 |
| 605 | {TDA} [AC4Abu] [Aeea] [Aeea] Q R P [NMeArg] [aMeLeu] S H K G [Pip] [Nle] [aMePro] [4-Cl-F] {COOH} | 0.00008315 | 0.000298 |
| 457 | {TDA} [AC4Abu] [Aeea] [Aeea] Q R P [NMeArg] [aMeLeu] S H K G P [Nle] P [4-Cl-F] {COOH} | 0.00002295 | 0.0000564 |
| 472 | {TDA} [AC4Abu] [Aeea] [Aeea] Q R P [NMeArg] [aMeLeu] S H K G P [Nle] P [2Nal] {COOH} | 0.00002035 | 0.000092 |
| 422 | {TDA} [AC4Abu] [Aeea] [Aeea] Q R P [NMeArg] [BhLeu] S H K G P [Nle] P [4-Cl-F] {COOH} | 0.00016875 | 0.0001965 |
| 391 | {TDA} [AC4Abu] [Aeea] [Aeea] Q R P [NMeArg] [BLeu] S H K G [Oic] [Nle] P [4-Cl-F] {COOH} | 0.000565 | 0.001503 |
| 458 | {TDA} [AC4Abu] [Aeea] [Aeea] Q R P [NMeArg] [BLeu] S H K G P [Nle] P [4-Cl-F] {COOH} | 0.00002425 | 0.0001195 |
| 500 | {TDA} [AC4Abu] [Aeea] [Aeea] q R P [NMeArg] [Cha] [BhSer] H K G [Oic] [Nle] [Aib] [4-Cl-F] {COOH} | 0.0005875 | 0.0031378 |
| 438 | {TDA} [AC4Abu] [Aeea] [Aeea] Q R P [NMeArg] [Cha] S [Tle] K G [Oic] [Nle] P [4-Cl-F] {COOH} | 0.00149 | 0.0012775 |
| 419 | {TDA} [AC4Abu] [Aeea] [Aeea] Q R P [NMeArg] [Cha] S A K G [Oic] [Nle] P [4-Cl-F] {COOH} | 0.0004845 | 0.000379 |
| 530 | {TDA} [AC4Abu] [Aeea] [Aeea] q R P [NMeArg] [Cha] S A K G [Oic] [Nle] [Aib] [4-Cl-F] {COOH} | 0.00037975 | 0.0009745 |
| 444 | {TDA} [AC4Abu] [Aeea] [Aeea] Q R P [NMeArg] [Cha] S H [AMe-K] G [Oic] [Nle] P [4-Cl-F] {COOH} | 0.0056 | 0.01006 |
| 543 | {TDA} [AC4Abu] [Aeea] [Aeea] q R P [NMeArg] [Cha] S H K [Tle] [Oic] [Nle] [Aib] [4-Cl-F] {COOH} | 0.00058275 | 0.0014035 |
| 414 | {TDA} [AC4Abu] [Aeea] [Aeea] Q R P [NMeArg] [Cha] S H K G [Aib] [Nle] P [4-Cl-F] {COOH} | 0.00339 | 0.003785 |

TABLE 16-continued

| SEQ ID NO: | SEQUENCE | EC50 Human APJ Receptor (μM) | EC50 Rat APJ Receptor (μM) |
|---|---|---|---|
| APJ Agonist Activity of Modified Apelin Polypeptides | | | |
| 418 | {TDA} [AC4Abu] [Aeea] [Aeea] Q R P [NMeArg] [Cha] S H K G [aMePro] [Nle] P [4-Cl-F] {COOH} | 0.00014673 | 0.00025275 |
| 498 | {TDA} [AC4Abu] [Aeea] [Aeea] q R P [NMeArg] [Cha] S H K G [aMePro] [Nle] [Aib] [4-Cl-F] {COOH} | 0.0000299 | 0.0001375 |
| 545 | {TDA} [AC4Abu] [Aeea] [Aeea] q R P [NMeArg] [Cha] S H K G [aMePro] [Nle] [BhPro] [4-Cl-F] {COOH} | 0.0013005 | 0.0036975 |
| 551 | {TDA} [AC4Abu] [Aeea] [Aeea] q R P [NMeArg] [Cha] S H K G [aMePro] [Nle] [4-Cl-F] {COOH} | 0.0002345 | 0.0011455 |
| 417 | {TDA} [AC4Abu] [Aeea] [Aeea] Q R P [NMeArg] [Cha] S H K G [BhPro] [Nle] P [4-Cl-F] {COOH} | 0.00599 | 0.008095 |
| 415 | {TDA} [AC4Abu] [Aeea] [Aeea] Q R P [NMeArg] [Cha] S H K G [Deg] [Nle] P [4-Cl-F] {COOH} | 0.003915 | 0.00401 |
| 377 | {TDA} [AC4Abu] [Aeea] [Aeea] q R P [NMeArg] [Cha] S H K G [Oic] [Nle] P [4-Cl-F] {COOH} | 0.0003875 | 0.000447 |
| 379 | {TDA} [AC4Abu] [Aeea] [Aeea] Q R P [NMeArg] [Cha] S H K G [Oic] [Nle] P [BhPhe] {COOH} | 0.007525 | 0.008375 |
| 380 | {TDA} [AC4Abu] [Aeea] [Aeea] Q R P [NMeArg] [Cha] S H K G [Oic] [Nle] P [D-BhPhe] {COOH} | 0.016665 | 0.00477 |
| 381 | {TDA} [AC4Abu] [Aeea] [Aeea] Q R P [NMeArg] [Cha] S H K G [Oic] [Nle] P [D-4ClF] {COOH} | 0.006115 | 0.005425 |
| 382 | {TDA} [AC4Abu] [Aeea] [Aeea] Q R P [NMeArg] [Cha] S H K G [Oic] [Nle] [Aib] [4-Cl-F] {COOH} | 0.0004685 | 0.000682 |
| 390 | {TDA} [AC4Abu] [Aeea] [Aeea] Q R P [NMeArg] [Cha] S H K G [Oic] [Nle] P [4-Cl-F] {COOH} | 0.0001103 | 0.00057 |
| 409 | {TDA} [AC4Abu] [Aeea] [Aeea] Q R P [NMeArg] [Cha] S H K G [Oic] [Nle] [4-Cl-F] {COOH} | 0.001003 | 0.000511 |
| 410 | {TDA} [AC4Abu] [Aeea] [Aeea] Q R P [NMeArg] [Cha] S H K G [Oic] [Nle] [D-4ClF] {COOH} | 0.002465 | 0.00268 |
| 411 | {TDA} [AC4Abu] [Aeea] [Aeea] Q R P [NMeArg] [Cha] S H K G [Oic] [Nle] [Deg] [4-Cl-F] {COOH} | 0.002105 | 0.00294 |
| 412 | {TDA} [AC4Abu] [Aeea] [Aeea] Q R P [NMeArg] [Cha] S H K G [Oic] [Nle] [aMePro] [4-Cl-F] {COOH} | 0.000614 | 0.0004365 |
| 413 | {TDA} [AC4Abu] [Aeea] [Aeea] Q R P [NMeArg] [Cha] S H K G [Oic] [Tle] P [4-Cl-F] {COOH} | 0.0015275 | 0.001538 |
| 445 | {TDA} [AC4Abu] [Aeea] [Aeea] Q R P [NMeArg] [Cha] S H K G [Oic] [Nle] [Pip] [4-Cl-F] {COOH} | 0.004285 | 0.00471 |

TABLE 16-continued

| SEQ ID NO: | SEQUENCE | EC50 Human APJ Receptor (μM) | EC50 Rat APJ Receptor (μM) |
|---|---|---|---|
| | APJ Agonist Activity of Modified Apelin Polypeptides | | |
| 487 | {TDA} [AC4Abu] [Aeea] [Aeea] Q R P [NMeArg] [Cha] S H K G [Oic] [Nle] [BhPro] [4-Cl-F] {COOH} | 0.0018275 | 0.00819 |
| 540 | {TDA} [AC4Abu] [Aeea] [Aeea] q R P [NMeArg] [Cha] S H K G [Oic] [Nle] [Aib] [4-Cl-F] {COOH} | 0.0004105 | 0.0012265 |
| 541 | {TDA} [AC4Abu] [Aeea] [Aeea] q R P [NMeArg] [Cha] S H K G [Oic] [Nle] [aMePro] [4-Cl-F] {COOH} | 0.00093825 | 0.0019788 |
| 542 | {TDA} [AC4Abu] [Aeea] [Aeea] q R P [NMeArg] [Cha] S H K G [Oic] [Nle] [BhPro] [4-Cl-F] {COOH} | 0.00519 | 0.016075 |
| 549 | {TDA} [AC4Abu] [Aeea] [Aeea] q R P [NMeArg] [Cha] S H K G [Oic] [Nle] [Deg] [4-Cl-F] {COOH} | 0.001195 | 0.004 |
| 416 | {TDA} [AC4Abu] [Aeea] [Aeea] Q R P [NMeArg] [Cha] S H K G [Pip] [Nle] P [4-Cl-F] {COOH} | 0.0001915 | 0.000346 |
| 499 | {TDA} [AC4Abu] [Aeea] [Aeea] q R P [NMeArg] [Cha] S H K G [Pip] [Nle] [Aib] [4-Cl-F] {COOH} | 0.00002365 | 0.00008525 |
| 544 | {TDA} [AC4Abu] [Aeea] [Aeea] q R P [NMeArg] [Cha] S H K G [Pip] [Nle] [BhPro] [4-Cl-F] {COOH} | 0.0024225 | 0.0056075 |
| 361 | {TDA} [AC4Abu] [Aeea] [Aeea] Q R P [NMeArg] [Cha] S H K G P [Nle] P [4-Cl-F] {COOH} | 0.0003085 | 0.000085967 |
| 437 | {TDA} [AC4Abu] [Aeea] [Aeea] Q R P [NMeArg] [Cha] S V K G [Oic] [Nle] P [4-Cl-F] {COOH} | 0.0006635 | 0.0007245 |
| 436 | {TDA} [AC4Abu] [Aeea] [Aeea] Q R P [NMeArg] [Cha] S Y K G [Oic] [Nle] P [4-Cl-F] {COOH} | 0.000793 | 0.00147 |
| 531 | {TDA} [AC4Abu] [Aeea] [Aeea] q R P [NMeArg] [Cha] S Y K G [Oic] [Nle] [Aib] [4-Cl-F] {COOH} | 0.0008515 | 0.00566 |
| 459 | {TDA} [AC4Abu] [Aeea] [Aeea] Q R P [NMeArg] [NMeLeu] S H K G P [Nle] P [4-Cl-F] {COOH} | 0.00007275 | 0.00023 |
| 439 | {TDA} [AC4Abu] [Aeea] [Aeea] Q R P [NMeArg] [Tle] S H K G [Oic] [Nle] P [4-Cl-F] {COOH} | 0.00215 | 0.003205 |
| 468 | {TDA} [AC4Abu] [Aeea] [Aeea] Q R P [NMeArg] L [aMeS] H K G P [Nle] P [4-Cl-F] {COOH} | 0.00002925 | 0.000165 |
| 464 | {TDA} [AC4Abu] [Aeea] [Aeea] Q R P [NMeArg] L [bAla] H K G P [Nle] P [4-Cl-F] {COOH} | 0.00005425 | 0.000377 |
| 467 | {TDA} [AC4Abu] [Aeea] [Aeea] Q R P [NMeArg] L [NhSerG] H K G P [Nle] P [4-Cl-F] {COOH} | 0.0001287 | 0.0005205 |
| 450 | {TDA} [AC4Abu] [Aeea] [Aeea] Q R P [NMeArg] L [Pra] H K G P [Nle] P [4-Cl-F] {COOH} | 0.000132 | 0.000313 |

TABLE 16-continued

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 423 | {TDA} [AC4Abu] [Aeea] [Aeea] Q R P [NMeArg] L S [bAla] K G P [Nle] P [4-Cl-F] {COOH} | 0.000645 | 0.001182 |
| 469 | {TDA} [AC4Abu] [Aeea] [Aeea] Q R P [NMeArg] L S [rHis] K G P [Nle] P [4-Cl-F] {COOH} | 0.0001775 | 0.001329 |
| 449 | {TDA} [AC4Abu] [Aeea] [Aeea] Q R P [NMeArg] L S H [1-Nal] G P [Nle] P [4-Cl-F] {COOH} | 0.000394 | 0.00047 |
| 424 | {TDA} [AC4Abu] [Aeea] [Aeea] Q R P [NMeArg] L S H [bAla] G P [Nle] P [4-Cl-F] {COOH} | 0.004145 | 0.017205 |
| 466 | {TDA} [AC4Abu] [Aeea] [Aeea] Q R P [NMeArg] L S H [Nle] G P [Nle] P [4-Cl-F] {COOH} | 0.0000461 | 0.0001925 |
| 448 | {TDA} [AC4Abu] [Aeea] [Aeea] Q R P [NMeArg] L S H H G P [Nle] P [4-Cl-F] {COOH} | 0.0001335 | 0.0003055 |
| 352 | {TDA} [AC4Abu] [Aeea] [Aeea] Q R P [NMeArg] L S H K G [Oic] [Nle] P [4-Cl-F] {COOH} | 0.0001085 | 0.00022983 |
| 403 | {TDA} [AC4Abu] [Aeea] [Aeea] Q R P [NMeArg] L S H K G P [Nle] [2Nal] {COOH} | 0.00263 | 0.008095 |
| 402 | {TDA} [AC4Abu] [Aeea] [Aeea] Q R P [NMeArg] L S H K G P [Nle] [4-Cl-F] {COOH} | 0.0001002 | 0.0002465 |
| 401 | {TDA} [AC4Abu] [Aeea] [Aeea] Q R P [NMeArg] L S H K G P [Nle] [aMePro] [4-Cl-F] {COOH} | 0.0000816 | 0.0003515 |
| 425 | {TDA} [AC4Abu] [Aeea] [Aeea] Q R P [NMeArg] L S H K G P [Nle] [bAla] [4-Cl-F] {COOH} | 0.0000937 | 0.000157 |
| 426 | {TDA} [AC4Abu] [Aeea] [Aeea] Q R P [NMeArg] L S H K G P [Nle] [BhPro] [4-Cl-F] {COOH} | 0.0001062 | 0.0003825 |
| 429 | {TDA} [AC4Abu] [Aeea] [Aeea] Q R P [NMeArg] L S H K G P [Nle] [Pip] [4-Cl-F] {COOH} | 0.00006635 | 0.00009355 |
| 287 | {TDA} [AC4Abu] [Aeea] [Aeea] Q R P [NMeArg] L S H K G P [Nle] P [4-Cl-F] {COOH} | 0.0000749 | 0.00024185 |
| 470 | {TDA} [AC4Abu] [Aeea] [Aeea] Q R P [NMeArg] L S H K G P [Nle] P [2Nal] {COOH} | 0.00003795 | 0.0001495 |
| 456 | {TDA} [AC4Abu] [Aeea] [Aeea] Q r P [NMehArg] [aMeLeu] S H K G P [Nle] P [4-Cl-F] {COOH} | 0.0000292 | 0.000178 |
| 384 | {TDA} [AC4Abu] [Aeea] [Aeea] Q r P [NMehArg] [BLeu] S H K G P [Nle] P [4-Cl-F] {COOH} | 0.0009565 | 0.00435 |
| 435 | {TDA} [AC4Abu] [Aeea] [Aeea] Q r P [NMehArg] [Cha] S H K G P [Nle] P [4-Cl-F] {COOH} | 0.0004605 | 0.0011465 |

TABLE 16-continued

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 471 | {TDA} [AC4Abu] [Aeea] [Aeea] Q R P [NMehArg] L S H K G P [Nle] P [2Nal] {COOH} | 0.0000229 | 0.0000974 |
| 526 | {TDA} [AC4Abu] [Aeea] [Aeea] q R P E [Cha] S H K G [Oic] [Nle] [Aib] [4-Cl-F] {COOH} | 0.002025 | 0.0072 |
| 527 | {TDA} [AC4Abu] [Aeea] [Aeea] q R P e [Cha] S H K G [Oic] [Nle] [Aib] [4-Cl-F] {COOH} | 0.1075 | 0.227 |
| 477 | {TDA} [AC4Abu] [Aeea] [Aeea] Q R P E L S H K G P [Nle] P [4-Cl-F] {COOH} | 0.000423 | 0.000691 |
| 427 | {TDA} [AC4Abu] [Aeea] [Aeea] Q R P P L S H K G P [Nle] P [4-Cl-F] {COOH} | 0.0001705 | 0.000313 |
| 465 | {TDA} [AC4Abu] [Aeea] [Aeea] Q R P Q L S H K G P [Nle] P [4-Cl-F] {COOH} | 0.0000692 | 0.0001745 |
| 430 | {TDA} [AC4Abu] [Aeea] [Aeea] Q r P r [Cha] S H K G [Oic] [Nle] P [4-Cl-F] {COOH} | 0.0012155 | 0.002835 |
| 480 | {TDA} [AC4Abu] [Aeea] [Aeea] r Q [hArg] P [hArg] [Cha] S H K G [Oic] [Nle] P [4-Cl-F] {COOH} | 0.00009985 | 0.000271 |
| 481 | {TDA} [AC4Abu] [Aeea] [Aeea] r q [hArg] P [hArg] [Cha] S H K G [Oic] [Nle] P [4-Cl-F] {COOH} | 0.0001765 | 0.000341 |
| 479 | {TDA} [AC4Abu] [Aeea] [Aeea] r Q [hArg] P [NMeArg] [Cha] S H K G [Oic] [Nle] P [4-Cl-F] {COOH} | 0.0004085 | 0.0008055 |
| 348 | {TDA} [AC4Abu] [Aeea] [Aeea] R Q [Nle] P [hArg] [Cha] A A K G [Oic] [Nle] P [4-Cl-F] {COOH} | 0.004915 | 0.007455 |
| 343 | {TDA} [AC4Abu] [Aeea] [Aeea] R Q [Nle] P [hArg] [Cha] S A K G [Oic] [Nle] P [4-Cl-F] {COOH} | 0.001395 | 0.00124 |
| 564 | {TDA} [AC4Abu] [Aeea] [Aeea] R Q [Nle] P [hArg] [Cha] S A K G [Pip] [Nle] P [4-Cl-F] {COOH} | 0.000331 | 0.0014925 |
| 339 | {TDA} [AC4Abu] [Aeea] [Aeea] R Q [Nle] P [hArg] [Cha] S H K G [Oic] [Nle] P [4-Cl-F] {COOH} | 0.00255 | 0.004525 |
| 351 | {TDA} [AC4Abu] [Aeea] [Aeea] R Q R P [hArg] [Cha] A A [Nle] G [Oic] [Nle] P [4-Cl-F] {COOH} | 0.001595 | 0.001805 |
| 340 | {TDA} [AC4Abu] [Aeea] [Aeea] R Q R P [hArg] [Cha] S A [Nle] G [Oic] [Nle] P [4-Cl-F] {COOH} | 0.0003445 | 0.000676 |
| 336 | {TDA} [AC4Abu] [Aeea] [Aeea] R Q R P [hArg] [Cha] S H [Nle] G [Oic] [Nle] P [4-Cl-F] {COOH} | 0.000714 | 0.0009865 |
| 565 | {TDA} [AC4Abu] [Aeea] [Aeea] r Q R P [hArg] [NMeLeu] S H K G [Pip] [pI-Phe] P [D-Bip] {COOH} | 0.001023 | 0.00282 |

TABLE 16-continued

APJ Agonist Activity of Modified Apelin Polypeptides

| SEQ ID NO: | SEQUENCE | EC50 Human APJ Receptor (μM) | EC50 Rat APJ Receptor (μM) |
|---|---|---|---|
| 345 | {TDA} [AC4Abu] [Aeea] [Aeea] R Q R P [Nle] [Cha] A A K G [Oic] [Nle] P [4-Cl-F] {COOH} | 0.00451 | 0.005785 |
| 344 | {TDA} [AC4Abu] [Aeea] [Aeea] R Q R P [Nle] [Cha] A H K G [Oic] [Nle] P [4-Cl-F] {COOH} | 0.00346 | 0.005575 |
| 350 | {TDA} [AC4Abu] [Aeea] [Aeea] R Q R P [Nle] [Cha] S A K G [Oic] [Nle] P [4-Cl-F] {COOH} | 0.0002855 | 0.0006235 |
| 335 | {TDA} [AC4Abu] [Aeea] [Aeea] R Q R P [Nle] [Cha] S H K G [Oic] [Nle] P [4-Cl-F] {COOH} | 0.000315 | 0.000964 |
| 346 | {TDA} [AC4Abu] [Aeea] [Aeea] R Q R P K [Cha] A A [Nle] G [Oic] [Nle] P [4-Cl-F] {COOH} | 0.00277 | 0.002455 |
| 341 | {TDA} [AC4Abu] [Aeea] [Aeea] R Q R P K [Cha] S A [Nle] G [Oic] [Nle] P [4-Cl-F] {COOH} | 0.000561 | 0.001265 |
| 337 | {TDA} [AC4Abu] [Aeea] [Aeea] R Q R P K [Cha] S H [Nle] G [Oic] [Nle] P [4-Cl-F] {COOH} | 0.00208 | 0.00212 |
| 539 | {TDA} [AC4Abu] [NPeg11] q R P [NMeArg] [Cha] S H K G [Oic] [Nle] [Aib] [4-Cl-F] {COOH} | 0.00073525 | 0.003545 |
| 532 | {TDA} [AC4Abu] q R P [NMeArg] [Cha] S H K G [Oic] [Nle] [Aib] [4-Cl-F] {COOH} | 0.00068225 | 0.00299 |
| 507 | {TDA} [Aeea] [Aeea] Q R P [NMeArg] L S H K G P [Nle] P [4-Cl-F] {COOH} | 0.00007945 | 0.000245 |
| 538 | {TDA} d [Aeea] [Aeea] q R P [NMeArg] [Cha] S H K G [Oic] [Nle] [Aib] [4-Cl-F] {COOH} | 0.00052525 | 0.001891 |
| 546 | {TDA} D [Aeea] [Aeea] q R P [NMeArg] [Cha] S H K G [Oic] [Nle] [Aib] [4-Cl-F] {COOH} | 0.000478 | 0.0012335 |
| 537 | {TDA} E [Aeea] [Aeea] q R P [NMeArg] [Cha] S H K G [Oic] [Nle] [Aib] [4-Cl-F] {COOH} | 0.00028022 | 0.0010833 |
| 547 | {TDA} e [Aeea] [Aeea] q R P [NMeArg] [Cha] S H K G [Oic] [Nle] [Aib] [4-Cl-F] {COOH} | 0.00040425 | 0.0013333 |
| 511 | {TetDDA} [AC4Abu] [Aeea] [Aeea] Q R P [NMeArg] L S H K G P [Nle] P [4-Cl-F] {COOH} | 0.000181 | 0.0009685 |

Example 11. Immunoglobulin Fc-Apelin Peptide Conjugates

Four modified apelin polypeptides of the invention (SEQ ID NOs: 8-11) were used for site selective conjugation to an engineered Fe region of a human IgG. The peptides were conjugated to the Fc region through a bromoacetyl-NPeg11 linker attached at the amino terminus of the peptides. By reacting the bromoacetamide portion of the linker with a free cysteine residue in the Fc protein, a covalent thioether linkage was formed as illustrated below.

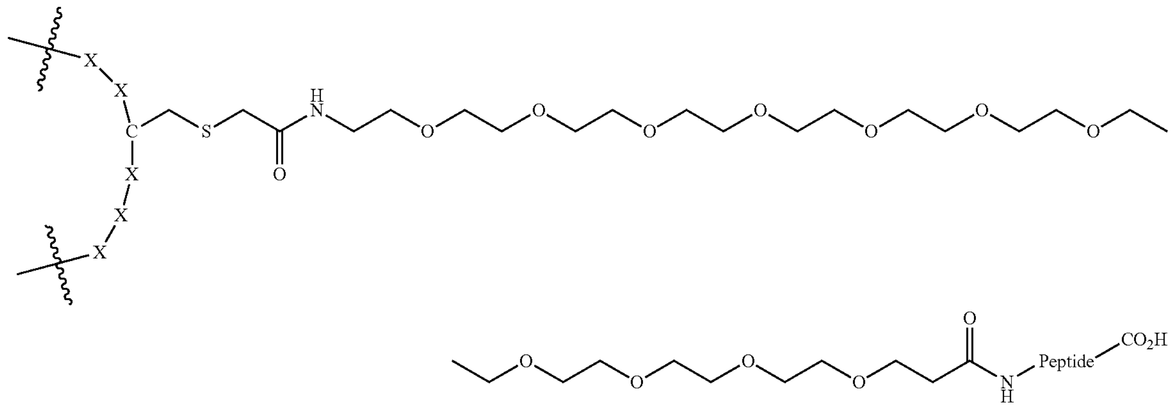

The sequences of the four peptides are shown in Table 17. The human IgG Fc protein sequence is shown below.

| Human IgG Fc Sequence (SEQ ID NO: 716) | | |
|---|---|---|
| 1 | MDKTHTCPPCPAPELLGGPSVFLFPPKPKD | 30 |
| 31 | TLMISRTPEVTCVVVDVSHEDPCVKENWYV | 60 |
| 61 | DGVEVHNAKTKPREEQYNSTYRVVSVLTVL | 90 |
| 91 | HQDWLNGKEYKCKVSNKALPAPIEKTISKA | 120 |
| 121 | KGQPREPQVYTLPPSRDELTKNQVSLTCLV | 150 |
| 151 | KGFYPSDIAVEWESNGQPENNYKTTPPVLD | 180 |
| 181 | SDGSFFLYSKLTVDKSRWQQGNVFSCSVMH | 210 |
| 211 | EALHNHYTQKSLSLSPGK | |

The underlined C indicates the site of an engineered cysteine and the point of covalent attachment of the modified apelin polypeptide. In the homodimer C7-C7 and C10-C10 are intermolecular disulfides, whereas C42-C102 and C148-C206 are intramolecular disulfides.

TABLE 17

Amino Acid Sequences of Modified Apelin Polypeptides for Site-Selective Fc Conjugation

| SEQ ID NO: | AMINO ACID SEQUENCE |
|---|---|
| 8 | QrP[hArg][aMeLeu]SHKGP[Nle]P[4-Cl-F] {COOH} |
| 9 | QR[aMePro][hArg][aMeLeu]SHKGP[Nle]P [4-Cl-F] {COOH} |
| 10 | Q[NMehArg]P[NMeArg][aMeLeu]SHKGP[Nle] P[4-Cl-F]{COOH} |
| 11 | Q R P [NMeArg] [Cha] S H K G [Oic] [Nle] [Aib] [4-Cl-F] {COOH} |

The Fc protein forms a homodimer upon folding and thus contains two engineered cysteine reactive sites per folded protein. Each Fc-homodimer conjugate will ideally contain two copies of the modified apelin polypeptide. Each of the conjugates were evaluated for efficacy in activating the rat and human APJ receptors as measured by the GTPγS assay (see Example 3 for methods). The conjugates were also tested for induction of histamine release from rat mast cells (see Example 7 for methods). The results of these experiments are summarized in Table 18 below. The data for the unconjugated peptides are also shown for comparison. As can be seen from the results in the table, conjugation of the apelin peptides did not significantly affect the peptide's potency in activating the APJ receptor. In addition, none of the Fc-peptide conjugates induced histamine release from rat mast cells. In one case, the Fc-conjugate eliminated the histamine release activity of the unconjugated peptide (see Fc-peptide conjugate #4).

TABLE 18

Comparison of Fc-Apelin Peptide Conjugates to Unconjugated Apelin Peptides

| Compound | SEQ ID NO: | SEQUENCE/ DESCRIPTION | EC50 Human APJ Receptor (μM) | EC50 Rat APJ Receptor (μM) | Histamine release? |
|---|---|---|---|---|---|
| Acetylated version of peptide in Fc-peptide conjugate #1 | 70 | {Acetyl-NH}Q[r]P [hArg] [aMeLeu]S HKGP[Nle] P[4-Cl-F] {COOH} | 0.0001925 | 0.009735 | No |
| Fc-peptide conjugate #1 | — | human IgG Fc conjugate of apelin peptide of SEQ ID NO: 8 | 0.000258 | 0.00107 | No |
| Acetylated version of peptide in Fc-peptide conjugate #2 | 69 | {Acetyl-NH}QR [aMePro] [hArg] [aMeLeu] SHKGP [Nle]P [4-Cl-F] {COOH} | 0.0000417 | 0.0003135 | No |

TABLE 18-continued

Comparison of Fc-Apelin Peptide Conjugates to Unconjugated Apelin Peptides

| Compound | SEQ ID NO: | SEQUENCE/ DESCRIPTION | EC50 Human APJ Receptor (μM) | EC50 Rat APJ Receptor (μM) | Histamine release? |
|---|---|---|---|---|---|
| Fc-peptide conjugate #2 | — | human IgG Fc conjugate of apelin peptide of SEQ ID NO: 9 | 0.000208 | 0.000304 | No |
| Acetylated version of peptide in Fc-peptide conjugate #3 | 95 | {Acetyl-NH}Q [NMehArg] P[NMeArg] [aMeLeu] SHKGP [Nle]P [4-Cl-F] {COOH} | 0.000177 | 0.00393 | No |
| Fc-peptide conjugate #3 | — | human IgG Fc conjugate of apelin peptide of SEQ ID NO: 10 | 0.000319 | 0.000682 | No |
| Acetylated version of peptide in Fc-peptide conjugate #4 | 92 | {Acetyl-NH}QRP [NMeArg] [Cha] SHKG [Oic] [Nle] [Aib] [4-Cl-F} {COOH} | 0.000679 | 0.0032275 | Yes |
| Fc-peptide conjugate #4 | — | human IgG Fc conjugate of apelin peptide of SEQ ID NO: 11 | 0.000746 | 0.00137 | No |

Throughout this specification various publications, patents and patent applications have been referenced. The disclosures of these documents in their entireties are hereby incorporated by reference into this application. The reference to such documents, however, should not be construed as an acknowledgment that such documents are prior art to the application.

SEQUENCE LISTING (773 sequences)

SEQ ID NO: 1 - skipped

SEQ ID NO: 2 - protein, 77 aa, Homo sapiens
MNLRLCVQALLLLWLSLTAVCGGSLMPLPDGNGLEDGNVRHLVQPRGSRNGPGPWQGGRRKFRRQRPRLSHKGPMPF

SEQ ID NO: 3 - protein, 36 aa, Homo sapiens
LVQPRGSRNGPGPWQGGRRKFRRQRPRLSHKGPMPF

SEQ ID NO: 4 - protein, 13 aa, Homo sapiens
QRPRLSHKGPMPF

SEQ ID NO: 5 - protein, 17 aa, Homo sapiens
KFRRQRPRLSHKGPMPF

SEQ ID NO: 6 - protein, 13 aa, synthetic construct
  MOD_RES 1: note = pyroglutamic acid
  REGION 1..13: note = source = /note="Description of Artificial Sequence: Synthetic peptide"
XRPRLSHKGPMPF

SEQ ID NO: 7 - protein, 14 aa, synthetic construct
  MOD_RES 5: note = D-Arg
  MOD_RES 6: note = N-alpha-methylleucine
  MOD_RES 11: note = octahydroindole-2-carboxylic acid
  MOD_RES 12: note = para-iodophenylalanine
  MOD_RES 14: note = (R)-3-([1,1'-biphenyl]-4-yl)-2-aminopropanoic acid
  REGION 1..14: note = source = /note="Description of Artificial Sequence: Synthetic peptide"
RQRPRLSHKGXFPX

SEQ ID NO: 8 - protein, 13 aa, synthetic construct
  MOD_RES 2: note = D-Arg
  MOD_RES 4: note = homo-L-Arginine
  MOD_RES 5: note = Alpha-methyl-leucine
  MOD_RES 11: note = Norleucine
  MOD_RES 13: note = 4-chloro-L-phenylalanine
  REGION 1..13: note = source = /note="Description of Artificial Sequence: Synthetic peptide"
QRPRLSHKGPXPF

SEQ ID NO: 9 - protein, 13 aa, synthetic construct
  MOD_RES 3: note = Alpha-methyl-proline
  MOD_RES 4: note = homo-L-Arginine
  MOD_RES 5: note = Alpha-methyl-leucine
  MOD_RES 11: note = Norleucine
  MOD_RES 13: note = 4-chloro-L-phenylalanine
  REGION 1..13: note = source = /note="Description of Artificial Sequence: Synthetic peptide"
QRPRLSHKGPXPF

SEQ ID NO: 10 - protein, 13 aa, synthetic construct
  MOD_RES 2: note = (S)-6-guanidino-2-(methylamino)hexanoic acid
  MOD_RES 4: note = (S)-5-guanidino-2-(methylamino)pentanoic acid; N-alpha-methylarginine
  MOD_RES 5: note = Alpha-methyl-leucine
  MOD_RES 11: note = Norleucine
  MOD_RES 13: note = 4-chloro-L-phenylalanine
  REGION 1..13: note = source = /note="Description of Artificial Sequence: Synthetic peptide"
QRPRLSHKGPXPF

SEQ ID NO: 11 - protein, 13 aa, synthetic construct
  MOD_RES 4: note = (S)-5-guanidino-2-(methylamino)pentanoic acid; N-alpha-methylarginine
  MOD_RES 5: note = Cyclohexylalanine
  MOD_RES 10: note = octahydroindole-2-carboxylic acid
  MOD_RES 11: note = Norleucine
  MOD_RES 12: note = Alpha-amino-isobutyric acid
  MOD_RES 13: note = 4-chloro-L-phenylalanine
  REGION 1..13: note = source = /note="Description of Artificial Sequence: Synthetic peptide"
QRPRXSHKGXXXF

SEQ ID NO: 12 - protein, 16 aa, synthetic construct
  REGION 1..16: note = source = /note="Description of Artificial Sequence: Synthetic peptide"
KFRRQRPRLSHKGPMP

SEQ ID NO: 13 - protein, 11 aa, synthetic construct
  REGION 1..11: note = source = /note="Description of Artificial Sequence: Synthetic peptide"
CMPLHSRVPFP

SEQ ID NO: 14 - protein, 22 aa, synthetic construct
  MOD_RES 7: note = Aminobutyric acid
  MOD_RES 12: note = Aminobutyric acid
  REGION 1..22: note = source = /note="Description of Artificial Sequence: Synthetic peptide"
KLRKHNXLQRRXMPLHSRVPFP

SEQ ID NO: 15 - protein, 22 aa, synthetic construct
  REGION 1..22: note = source = /note="Description of Artificial Sequence: Synthetic peptide"
KLRKHNCLQRRCMPLHSRVPFP

SEQ ID NO: 16 - protein, 15 aa, synthetic construct
  MOD_RES 1: note = homo-L-Arginine
  MOD_RES 2: note = D-Arg
  MOD_RES 4: note = homo-L-Arginine
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPRLSHKGXFPX

SEQ ID NO: 17 - protein, 14 aa, synthetic construct
  MOD_RES 5: note = homo-L-Arginine
  MOD_RES 6: note = Cyclohexylalanine
  MOD_RES 11: note = octahydroindole-2-carboxylic acid
  MOD_RES 12: note = Norleucine
  MOD_RES 14: note = 4-chloro-L-phenylalanine
  REGION 1..14: note = source = /note="Description of Artificial Sequence: Synthetic peptide"
  REGION 1..14: note = source = /note="N-term Acetic acid"
RQRPRXSHKGXXPF

SEQ ID NO: 18 - protein, 15 aa, synthetic construct
  MOD_RES 1: note = D-Arg
  MOD_RES 2: note = homo-L-Arginine
  MOD_RES 4: note = homo-L-Arginine
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPRLSHKGXFPX

SEQ ID NO: 19 - protein, 15 aa, synthetic construct
  MOD_RES 1: note = homo-L-Arginine
  MOD_RES 2: note = homo-L-Arginine
  MOD_RES 3: note = D-Gln
  MOD_RES 4: note = homo-L-Arginine
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPRLSHKGXFPX

SEQ ID NO: 20 - protein, 15 aa, synthetic construct
  MOD_RES 1: note = homo-L-Arginine
  MOD_RES 2: note = homo-L-Arginine
  MOD_RES 4: note = D-Arg
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPRLSHKGXFPX

SEQ ID NO: 21 - protein, 15 aa, synthetic construct
  MOD_RES 1: note = homo-L-Arginine
  MOD_RES 2: note = homo-L-Arginine
  MOD_RES 4: note = homo-L-Arginine
  MOD_RES 5: note = octahydroindole-2-carboxylic acid
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRXRLSHKGXFPX

SEQ ID NO: 22 - protein, 15 aa, synthetic construct
  MOD_RES 1: note = homo-L-Arginine
  MOD_RES 2: note = homo-L-Arginine
  MOD_RES 4: note = D-Arg
  MOD_RES 6: note = (S)-5-guanidino-2-(methylamino)pentanoic acid; N-alpha-methylarginine
  MOD_RES 7: note = Cyclohexylalanine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPRXSHKGXFPX

SEQ ID NO: 23 - protein, 14 aa, synthetic construct
  MOD_RES 1: note = homo-L-Arginine
  MOD_RES 3: note = D-Arg
  MOD_RES 5: note = (S)-5-guanidino-2-(methylamino)pentanoic acid; N-alpha-methylarginine
  MOD_RES 6: note = Cyclohexylalanine
  MOD_RES 11: note = octahydroindole-2-carboxylic acid
  MOD_RES 12: note = Norleucine
  MOD_RES 14: note = 4-chloro-L-phenylalanine
  REGION 1..14: note = source = /note="Description of Artificial Sequence: Synthetic peptide"
  REGION 1..14: note = source = /note="N-term Acetic acid"
RQRPRXSHKGXXPF

SEQ ID NO: 24 - protein, 14 aa, synthetic construct
  MOD_RES 1: note = homo-L-Arginine
  MOD_RES 3: note = D-Arg
  MOD_RES 5: note = (S)-5-guanidino-2-(methylamino)pentanoic acid; N-alpha-methylarginine
  MOD_RES 6: note = Cyclohexylalanine
  MOD_RES 11: note = octahydroindole-2-carboxylic acid
  MOD_RES 12: note = Norleucine
  MOD_RES 14: note = 4-chloro-D-phenylalanine
  REGION 1..14: note = source = /note="Description of Artificial Sequence: Synthetic peptide"
  REGION 1..14: note = source = /note="N-term Acetic acid"
RQRPRXSHKGXXPF

SEQ ID NO: 25 - protein, 13 aa, synthetic construct
  MOD_RES 1: note = homo-L-Arginine
  MOD_RES 3: note = D-Arg
  MOD_RES 5: note = (S)-5-guanidino-2-(methylamino)pentanoic acid; N-alpha-methylarginine
  MOD_RES 6: note = Cyclohexylalanine
  MOD_RES 11: note = octahydroindole-2-carboxylic acid
  MOD_RES 12: note = Norleucine
  MOD_RES 13: note = 3-(1-naphthyl)-D-alanine
  REGION 1..13: note = source = /note="Description of Artificial Sequence: Synthetic peptide"
  REGION 1..13: note = source = /note="N-term Acetic acid"
RQRPRXSHKGXXX

SEQ ID NO: 26 - protein, 13 aa, synthetic construct
  MOD_RES 2: note = D-Arg
  MOD_RES 4: note = (S)-5-guanidino-2-(methylamino)pentanoic acid; N-alpha-methylarginine
  MOD_RES 5: note = Cyclohexylalanine
  MOD_RES 10: note = octahydroindole-2-carboxylic acid
  MOD_RES 11: note = Norleucine
  MOD_RES 13: note = 1,2,3,4-tetrahydroisoquinoline
  REGION 1..13: note = source = /note="Description of Artificial Sequence: Synthetic peptide"
  REGION 1..13: note = source = /note="N-term Acetic acid"
QRPRXSHKGXXPX

SEQ ID NO: 27 - protein, 13 aa, synthetic construct
  MOD_RES 1: note = D-Gln
  MOD_RES 2: note = homo-L-Arginine
  MOD_RES 4: note = (S)-5-guanidino-2-(methylamino)pentanoic acid; N-alpha-methylarginine
  MOD_RES 5: note = Cyclohexylalanine
  MOD_RES 10: note = octahydroindole-2-carboxylic acid
  MOD_RES 11: note = Norleucine
  MOD_RES 13: note = D-Phe
  REGION 1..13: note = source = /note="Description of Artificial Sequence: Synthetic peptide"
  REGION 1..13: note = source = /note="N-term Acetic acid"
QRPRXSHKGXXPF

SEQ ID NO: 28 - protein, 14 aa, synthetic construct
  MOD_RES 1: note = homo-L-Arginine
  MOD_RES 2: note = D-Gln
  MOD_RES 3: note = homo-L-Arginine
  MOD_RES 5: note = (S)-5-guanidino-2-(methylamino)pentanoic acid; N-alpha-methylarginine
  MOD_RES 6: note = Cyclohexylalanine
  MOD_RES 11: note = octahydroindole-2-carboxylic acid
  MOD_RES 12: note = Norleucine
  MOD_RES 14: note = D-Phe
  REGION 1..14: note = source = /note="Description of Artificial Sequence: Synthetic peptide"
  REGION 1..14: note = source = /note="N-term Acetic acid"
RQRPRXSHKGXXPF

SEQ ID NO: 29 - protein, 17 aa, synthetic construct
  MOD_RES 1: note = Ornithine
  MOD_RES 3: note = homo-L-Arginine
  MOD_RES 4: note = homo-L-Arginine
  MOD_RES 5: note = Beta-leucine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRLRPRXSHKGXXPF

SEQ ID NO: 30 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Beta-leucine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRLSHKGXXPF

SEQ ID NO: 31 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 10: note = N-alpha-(2-hydroxyethyl)-glycine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRXXHKGXXPF

SEQ ID NO: 32 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 12: note = 2-((4-aminobutyl)amino)acetic acid
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRXSHXGXXPF

SEQ ID NO: 33 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 7: note = Alpha-methyl-proline
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRXSHKGXXPF

SEQ ID NO: 34 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Alpha-methyl-leucine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRLSHKGXXPF

SEQ ID NO: 35 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 10: note = Alpha-methyl-serine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRXSHKGXXPF

SEQ ID NO: 36 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 12: note = Alpha-methyl-ornithine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRXSHXGXXPF

SEQ ID NO: 37 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 16: note = Alpha-methyl-proline
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRXSHKGXXPF

SEQ ID NO: 38 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homoArgininePsi(CH2NH) -reduced amide bond
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRXSHKGXXPF

SEQ ID NO: 39 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homoArgininePsi(CH2NH) -reduced amide bond
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRXSHKGXXPF

SEQ ID NO: 40 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 11: note = Histidine Psi(CH2NH) -reduced amide bond
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRXSHKGXXPF

SEQ ID NO: 41 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 12: note = Lysine Psi(CH2NH)-reduced amide bond
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRXSHKGXXPF

SEQ ID NO: 42 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine Psi(CH2NH) -reduced amide bond
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRXSHKGXXPF

SEQ ID NO: 43 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 10: note = Serine Psi(CH2NH) -reduced amide bond
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRXSHKGXXPF

SEQ ID NO: 44 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 10: note = D-Serine Psi(CH2NH)-reduced amide bond
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRXSHKGXXPF

SEQ ID NO: 45 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Acetic acid"
XFRRQRPRXSHKGXXPF

SEQ ID NO: 46 - protein, 17 aa, synthetic construct
  MOD_RES 1: note = Ornithine
  MOD_RES 3: note = homo-L-Arginine
  MOD_RES 4: note = homo-L-Arginine
  MOD_RES 8: note = homo-L-Arginine
  MOD_RES 9: note = Cyclohexylalanine
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Acetic acid"
XFRRQRPRXSHKGPFPX

SEQ ID NO: 47 - protein, 17 aa, synthetic construct
  MOD_RES 1: note = Ornithine
  MOD_RES 3: note = homo-L-Arginine
  MOD_RES 4: note = homo-L-Arginine
  MOD_RES 8: note = homo-L-Arginine
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Acetic acid"
XFRRQRPRLSHKGXFPX

SEQ ID NO: 48 - protein, 16 aa, synthetic construct
  MOD_RES 1: note = Ornithine
  MOD_RES 3: note = homo-L-Arginine
  MOD_RES 4: note = homo-L-Arginine
  MOD_RES 8: note = homo-L-Arginine
  MOD_RES 9: note = Cyclohexylalanine
  MOD_RES 15: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Acetic acid"
XFRRQRPRXSHKGPXF

SEQ ID NO: 49 - protein, 16 aa, synthetic construct
  MOD_RES 1: note = Ornithine
  MOD_RES 3: note = homo-L-Arginine
  MOD_RES 4: note = homo-L-Arginine
  MOD_RES 8: note = homo-L-Arginine
  MOD_RES 9: note = Cyclohexylalanine
  MOD_RES 15: note = Norleucine
  MOD_RES 16: note = 3-(2-naphthyl)alanine
  REGION 1..16: note = source = /note="Description of Artificial Sequence: Synthetic peptide"
  REGION 1..16: note = source = /note="N-term Acetic acid"
XFRRQRPRXSHKGPXX

SEQ ID NO: 50 - protein, 14 aa, synthetic construct
  MOD_RES 1: note = D-Arg
  MOD_RES 3: note = homo-L-Arginine
  MOD_RES 5: note = D-Arg
  MOD_RES 6: note = N-alpha-methylleucine
  MOD_RES 11: note = octahydroindole-2-carboxylic acid
  MOD_RES 12: note = para-iodophenylalanine
  MOD_RES 14: note = (R)-3-([1,1'-biphenyl]-4-yl)-2-aminopropanoic acid
  REGION 1..14: note = source = /note="Description of Artificial Sequence: Synthetic peptide"
  REGION 1..14: note = source = /note="N-term Acetic acid"
RQRPRLSHKGXFPX

SEQ ID NO: 51 - protein, 14 aa, synthetic construct
  MOD_RES 5: note = homo-L-Arginine
  MOD_RES 6: note = N-alpha-methylleucine
  MOD_RES 11: note = octahydroindole-2-carboxylic acid
  MOD_RES 12: note = para-iodophenylalanine
  MOD_RES 14: note = (R)-3-([1,1'-biphenyl]-4-yl)-2-aminopropanoic acid
  REGION 1..14: note = source = /note="Description of Artificial Sequence: Synthetic peptide"
  REGION 1..14: note = source = /note="N-term Acetic acid"
RQRPRLSHKGXFPX

SEQ ID NO: 52 - protein, 14 aa, synthetic construct
  MOD_RES 1: note = D-Arg
  MOD_RES 5: note = homo-L-Arginine
  MOD_RES 6: note = N-alpha-methylleucine
  MOD_RES 11: note = octahydroindole-2-carboxylic acid
  MOD_RES 12: note = para-iodophenylalanine
  MOD_RES 14: note = (R)-3-([1,1'-biphenyl]-4-yl)-2-aminopropanoic acid
  REGION 1..14: note = source = /note="Description of Artificial Sequence: Synthetic peptide"
  REGION 1..14: note = source = /note="N-term Acetic acid"
RQRPRLSHKGXFPX

SEQ ID NO: 53 - protein, 13 aa, synthetic construct
  MOD_RES 2: note = homo-L-Arginine
  MOD_RES 4: note = D-Arg
  MOD_RES 5: note = N-alpha-methylleucine
  MOD_RES 10: note = octahydroindole-2-carboxylic acid
  MOD_RES 11: note = para-iodophenylalanine
  MOD_RES 13: note = (R)-3-([1,1'-biphenyl]-4-yl)-2-aminopropanoic acid
  REGION 1..13: note = source = /note="Description of Artificial Sequence: Synthetic peptide"
  REGION 1..13: note = source = /note="N-term Acetic acid"
QRPRLSHKGXFPX

SEQ ID NO: 54 - protein, 12 aa, synthetic construct
  MOD_RES 2: note = D-Arg
  MOD_RES 4: note = (S)-5-guanidino-2-(methylamino)pentanoic acid; N-alpha-methylarginine
  MOD_RES 5: note = Cyclohexylalanine
  MOD_RES 10: note = octahydroindole-2-carboxylic acid
  MOD_RES 11: note = Norleucine
  MOD_RES 12: note = 3-(1-naphthyl)-D-alanine
  REGION 1..12: note = source = /note="Description of Artificial Sequence: Synthetic peptide"
  REGION 1..12: note = source = /note="N-term Acetic acid"
QRPRXSHKGXXX

SEQ ID NO: 55 - protein, 13 aa, synthetic construct
  MOD_RES 1: note = D-Gln
  MOD_RES 2: note = homo-L-Arginine
  MOD_RES 4: note = (S)-5-guanidino-2-(methylamino)pentanoic acid; N-alpha-methylarginine
  MOD_RES 5: note = Cyclohexylalanine
  MOD_RES 10: note = octahydroindole-2-carboxylic acid
  MOD_RES 11: note = Norleucine
  MOD_RES 13: note = 4-chloro-D-phenylalanine
  REGION 1..13: note = source = /note="Description of Artificial Sequence: Synthetic peptide"
  REGION 1..13: note = source = /note="N-term Acetic acid"
QRPRXSHKGXXPF

SEQ ID NO: 56 - protein, 15 aa, synthetic construct
  MOD_RES 1: note = homo-L-Arginine
  MOD_RES 2: note = homo-L-Arginine
  MOD_RES 4: note = homo-L-Arginine
  MOD_RES 6: note = (S)-5-guanidino-2-(methylamino)pentanoic acid; N-alpha-methylarginine
  MOD_RES 7: note = Cyclohexylalanine
  MOD_RES 12: note = octahydroindole-2-carboxylic acid
  MOD_RES 13: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term Acetic acid"
RRQRPRXSHKGXXPF

SEQ ID NO: 57 - protein, 16 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Acetic acid"
XFRRQRPRXSHKGXXF

SEQ ID NO: 58 - protein, 16 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 7: note = octahydroindole-2-carboxylic acid
  MOD_RES 8: note = D-Arg
  MOD_RES 9: note = Cyclohexylalanine
  MOD_RES 14: note = octahydroindole-2-carboxylic acid
  MOD_RES 15: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Acetic acid"
XFRRQRXRXSHKGXXF

SEQ ID NO: 59 - protein, 16 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Acetic acid"
XFRRQRPRLSHKGXXF

SEQ ID NO: 60 - protein, 14 aa, synthetic construct
  MOD_RES 1: note = homo-L-Arginine
  MOD_RES 3: note = homo-L-Arginine
  MOD_RES 5: note = (S)-5-guanidino-2-(methylamino)pentanoic acid; N-alpha-methylarginine
  MOD_RES 6: note = Cyclohexylalanine
  MOD_RES 11: note = octahydroindole-2-carboxylic acid
  MOD_RES 12: note = Norleucine
  MOD_RES 14: note = 4-chloro-L-phenylalanine
  REGION 1..14: note = source = /note="Description of Artificial Sequence: Synthetic peptide"
  REGION 1..14: note = source = /note="N-term Acetic acid"
RQRPRXSHKGXXPF

SEQ ID NO: 61 - protein, 13 aa, synthetic construct
  MOD_RES 2: note = homo-L-Arginine
  MOD_RES 4: note = (S)-5-guanidino-2-(methylamino)pentanoic acid; N-alpha-methylarginine
  MOD_RES 5: note = Cyclohexylalanine
  MOD_RES 10: note = octahydroindole-2-carboxylic acid
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term Acetic acid"
QRPRXSHKGXXPF

SEQ ID NO: 62 - protein, 14 aa, synthetic construct
  MOD_RES 12: note = Norleucine
  MOD_RES 14: note = (R)-3-([1,1'-biphenyl]-4-yl)-2-aminopropanoic acid
  REGION 1..14: note = source = /note="Description of Artificial Sequence: Synthetic peptide"
  REGION 1..14: note = source = /note="N-term Acetic acid"
RQRPRLSHKGPXPX

SEQ ID NO: 63 - protein, 14 aa, synthetic construct
  MOD_RES 6: note = Cyclohexylalanine
  MOD_RES 12: note = Norleucine
  MOD_RES 14: note = 4-chloro-L-phenylalanine
  REGION 1..14: note = source = /note="Description of Artificial Sequence: Synthetic peptide"
  REGION 1..14: note = source = /note="N-term Acetic acid"
RQRPRXSHKGPXPF

SEQ ID NO: 64 - protein, 14 aa, synthetic construct
  MOD_RES 6: note = N-alpha-methylleucine
  MOD_RES 12: note = Norleucine
  MOD_RES 14: note = 4-chloro-L-phenylalanine
  REGION 1..14: note = source = /note="Description of Artificial Sequence: Synthetic peptide"
  REGION 1..14: note = source = /note="N-term Acetic acid"
RQRPRLSHKGPXPF

SEQ ID NO: 65 - protein, 14 aa, synthetic construct
  MOD_RES 5: note = (S)-5-guanidino-2-(methylamino)pentanoic acid; N-alpha-methylarginine
  MOD_RES 12: note = Norleucine
  MOD_RES 14: note = 4-chloro-L-phenylalanine
  REGION 1..14: note = source = /note="Description of Artificial Sequence: Synthetic peptide"
  REGION 1..14: note = source = /note="N-term Acetic acid"
RQRPRLSHKGPXPF

SEQ ID NO: 66 - protein, 14 aa, synthetic construct
  MOD_RES 5: note = (S)-5-guanidino-2-(methylamino)pentanoic acid; N-alpha-methylarginine
  MOD_RES 6: note = Cyclohexylalanine
  MOD_RES 12: note = Norleucine
  MOD_RES 14: note = 4-chloro-L-phenylalanine
  REGION 1..14: note = source = /note="Description of Artificial Sequence: Synthetic peptide"
  REGION 1..14: note = source = /note="N-term Acetic acid"
RQRPRXSHKGPXPF

SEQ ID NO: 67 - protein, 14 aa, synthetic construct
  MOD_RES 5: note = (S)-5-guanidino-2-(methylamino)pentanoic acid; N-alpha-methylarginine
  MOD_RES 6: note = N-alpha-methylleucine
  MOD_RES 12: note = Norleucine
  MOD_RES 14: note = 4-chloro-L-phenylalanine
  REGION 1..14: note = source = /note="Description of Artificial Sequence: Synthetic peptide"
  REGION 1..14: note = source = /note="N-term Acetic acid"
RQRPRLSHKGPXPF

SEQ ID NO: 68 - protein, 13 aa, synthetic construct
  MOD_RES 4: note = (S)-5-guanidino-2-(methylamino)pentanoic acid; N-alpha-methylarginine
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term Acetic acid"
QRPRLSHKGPXPF

SEQ ID NO: 69 - protein, 13 aa, synthetic construct
  MOD_RES 3: note = Alpha-methyl-proline
  MOD_RES 4: note = homo-L-Arginine
  MOD_RES 5: note = Alpha-methyl-leucine
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term Acetic acid"
QRPRLSHKGPXPF

SEQ ID NO: 70 - protein, 13 aa, synthetic construct
  MOD_RES 2: note = D-Arg
  MOD_RES 4: note = homo-L-Arginine
  MOD_RES 5: note = Alpha-methyl-leucine
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term Acetic acid"
QRPRLSHKGPXPF

SEQ ID NO: 71 - protein, 13 aa, synthetic construct
  MOD_RES 2: note = homo-L-Arginine
  MOD_RES 4: note = (S)-5-guanidino-2-(methylamino)pentanoic acid; N-alpha-methylarginine
  MOD_RES 5: note = Alpha-methyl-leucine
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term Acetic acid"
QRPRLSHKGPXPF

SEQ ID NO: 72 - protein, 12 aa, synthetic construct
  MOD_RES 3: note = (S)-5-guanidino-2-(methylamino)pentanoic acid; N-alpha-methylarginine
  MOD_RES 10: note = Norleucine
  MOD_RES 12: note = 4-chloro-L-phenylalanine
  REGION 1..12: note = source = /note="Description of Artificial Sequence: Synthetic peptide"
  REGION 1..12: note = source = /note="N-term Acetic acid"
QRRLSHKGPXPF

SEQ ID NO: 73 - protein, 12 aa, synthetic construct
  MOD_RES 3: note = (S)-6-guanidino-2-(methylamino)hexanoic acid
  MOD_RES 10: note = Norleucine
  MOD_RES 12: note = 4-chloro-L-phenylalanine
  REGION 1..12: note = source = /note="Description of Artificial Sequence: Synthetic peptide"
  REGION 1..12: note = source = /note="N-term Acetic acid"
QRRLSHKGPXPF

SEQ ID NO: 74 - protein, 12 aa, synthetic construct
  MOD_RES 2: note = homo-L-Arginine
  MOD_RES 3: note = (S)-6-guanidino-2-(methylamino)hexanoic acid
  MOD_RES 10: note = Norleucine
  MOD_RES 12: note = 4-chloro-L-phenylalanine
  REGION 1..12: note = source = /note="Description of Artificial Sequence: Synthetic peptide"
  REGION 1..12: note = source = /note="N-term Acetic acid"
QRRLSHKGPXPF

SEQ ID NO: 75 - protein, 15 aa, synthetic construct
  MOD_RES 2: note = D-Arg
  MOD_RES 4: note = homo-L-Arginine
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
ERQRPRLSHKGXFPX

SEQ ID NO: 76 - protein, 15 aa, synthetic construct
  MOD_RES 1: note = homo-L-Arginine
  MOD_RES 4: note = homo-L-Arginine
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
REQRPRLSHKGXFPX

SEQ ID NO: 77 - protein, 15 aa, synthetic construct
  MOD_RES 1: note = homo-L-Arginine
  MOD_RES 2: note = D-Arg
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQEPRLSHKGXFPX

SEQ ID NO: 78 - protein, 15 aa, synthetic construct
  MOD_RES 1: note = homo-L-Arginine
  MOD_RES 2: note = D-Arg
  MOD_RES 4: note = homo-L-Arginine
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRERLSHKGXFPX

SEQ ID NO: 79 - protein, 15 aa, synthetic construct
  MOD_RES 1: note = homo-L-Arginine
  MOD_RES 2: note = D-Arg
  MOD_RES 4: note = homo-L-Arginine
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPELSHKGXFPX

SEQ ID NO: 80 - protein, 15 aa, synthetic construct
  MOD_RES 1: note = homo-L-Arginine
  MOD_RES 2: note = D-Arg
  MOD_RES 4: note = homo-L-Arginine
  MOD_RES 6: note = D-Arg
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPRESHKGXFPX

SEQ ID NO: 81 - protein, 15 aa, synthetic construct
  MOD_RES 1: note = homo-L-Arginine
  MOD_RES 2: note = D-Arg
  MOD_RES 4: note = homo-L-Arginine
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPRLEHKGXFPX

SEQ ID NO: 82 - protein, 15 aa, synthetic construct
  MOD_RES 1: note = homo-L-Arginine
  MOD_RES 2: note = D-Arg
  MOD_RES 4: note = homo-L-Arginine
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPRLSEKGXFPX

SEQ ID NO: 83 - protein, 15 aa, synthetic construct
  MOD_RES 1: note = homo-L-Arginine
  MOD_RES 2: note = D-Arg
  MOD_RES 4: note = homo-L-Arginine
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPRLSHEGXFPX

SEQ ID NO: 84 - protein, 15 aa, synthetic construct
  MOD_RES 1: note = homo-L-Arginine
  MOD_RES 2: note = D-Arg
  MOD_RES 4: note = homo-L-Arginine
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPRLSHKEXFPX

SEQ ID NO: 85 - protein, 15 aa, synthetic construct
  MOD_RES 1: note = homo-L-Arginine
  MOD_RES 2: note = D-Arg
  MOD_RES 4: note = homo-L-Arginine
  MOD_RES 6: note = D-Arg
  MOD_RES 7: note = N-alpha-methylleucine
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPRLSHKGEFPX

SEQ ID NO: 86 - protein, 15 aa, synthetic construct
  MOD_RES 1: note = homo-L-Arginine
  MOD_RES 2: note = D-Arg
  MOD_RES 4: note = homo-L-Arginine
  MOD_RES 6: note = D-Arg
  MOD_RES 7: note = N-alpha-methylleucine
  MOD_RES 12: note = octahydroindole-2-carboxylic acid
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPRLSHKGXEPX

SEQ ID NO: 87 - protein, 15 aa, synthetic construct
  MOD_RES 1: note = homo-L-Arginine
  MOD_RES 2: note = D-Arg
  MOD_RES 4: note = homo-L-Arginine
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPRLSHKGXFEX

SEQ ID NO: 88 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Acetic acid"
XXXQRPRLSHKGPXPF

SEQ ID NO: 89 - protein, 27 aa, synthetic construct
  MOD_RES 13: note = [2-(2-Amino-ethoxy)-ethoxy]-acetic acid
  MOD_RES 14: note = [2-(2-Amino-ethoxy)-ethoxy]-acetic acid
  MOD_RES 18: note = (S)-5-guanidino-2-(methylamino)pentanoic acid; N-alpha-methylarginine
  MOD_RES 25: note = Norleucine
  MOD_RES 27: note = 4-chloro-L-phenylalanine
  REGION 1..27: note = source = /note="Description of Artificial Sequence: Synthetic peptide"
  REGION 1..27: note = source = /note="N-term Acetic acid"
SDFYKRLINKAKXXQRPRLSHKGPXPF

SEQ ID NO: 90 - protein, 33 aa, synthetic construct
  MOD_RES 19: note = [2-(2-Amino-ethoxy)-ethoxy]-acetic acid
  MOD_RES 20: note = [2-(2-Amino-ethoxy)-ethoxy]-acetic acid
  MOD_RES 24: note = (S)-5-guanidino-2-(methylamino)pentanoic acid; N-alpha-methylarginine
  MOD_RES 31: note = Norleucine
  MOD_RES 33: note = 4-chloro-L-phenylalanine
  REGION 1..33: note = source = /note="Description of Artificial Sequence: Synthetic polypeptide"
  REGION 1..33: note = source = /note="N-term Acetic acid"
RLIEDICLPRWGCLWEDDXXQRPRLSHKGPXPF

SEQ ID NO: 91 - protein, 30 aa, synthetic construct
  MOD_RES 16: note = [2-(2-Amino-ethoxy)-ethoxy]-acetic acid
  MOD_RES 17: note = [2-(2-Amino-ethoxy)-ethoxy]-acetic acid
  MOD_RES 21: note = (S)-5-guanidino-2-(methylamino)pentanoic acid; N-alpha-methylarginine
  MOD_RES 28: note = Norleucine
  MOD_RES 30: note = 4-chloro-L-phenylalanine
  REGION 1..30: note = source = /note="Description of Artificial Sequence: Synthetic polypeptide"
  REGION 1..30: note = source = /note="N-term Acetic acid"
RLIEDICLPRWGCLWXXQRPRLSHKGPXPF

SEQ ID NO: 92 - protein, 13 aa, synthetic construct
  MOD_RES 4: note = (S)-5-guanidino-2-(methylamino)pentanoic acid; N-alpha-methylarginine
  MOD_RES 5: note = Cyclohexylalanine
  MOD_RES 10: note = octahydroindole-2-carboxylic acid
  MOD_RES 11: note = Norleucine
  MOD_RES 12: note = Alpha-amino-isobutyric acid
  MOD_RES 13: note = 4-chloro-L-phenylalanine
  REGION 1..13: note = source = /note="Description of Artificial Sequence: Synthetic peptide"
  REGION 1..13: note = source = /note="N-term Acetic acid"
QRPRXSHKGXXXF

SEQ ID NO: 93 - protein, 13 aa, synthetic construct
  MOD_RES 1: note = D-Gln
  MOD_RES 4: note = (S)-5-guanidino-2-(methylamino)pentanoic acid; N-alpha-methylarginine
  MOD_RES 5: note = Cyclohexylalanine
  MOD_RES 10: note = Alpha-methyl-proline
  MOD_RES 11: note = Norleucine
  MOD_RES 12: note = Alpha-amino-isobutyric acid
  MOD_RES 13: note = 4-chloro-L-phenylalanine
  REGION 1..13: note = source = /note="Description of Artificial Sequence: Synthetic peptide"
  REGION 1..13: note = source = /note="N-term Acetic acid"
QRPRXSHKGPXXF

SEQ ID NO: 94 - protein, 29 aa, synthetic construct
  MOD_RES 13: note = [2-(2-Amino-ethoxy)-ethoxy]-acetic acid
  MOD_RES 14: note = [2-(2-Amino-ethoxy)-ethoxy]-acetic acid
  MOD_RES 15: note = homo-L-Arginine
  MOD_RES 16: note = D-Arg
  MOD_RES 18: note = homo-L-Arginine
  MOD_RES 20: note = D-Arg
  MOD_RES 21: note = N-alpha-methylleucine
  MOD_RES 26: note = octahydroindole-2-carboxylic acid
  MOD_RES 27: note = para-iodophenylalanine
  MOD_RES 29: note = (R)-3-([1,1'-biphenyl]-4-yl)-2-aminopropanoic acid
  REGION 1..29: note = source = /note="Description of Artificial Sequence: Synthetic peptide"
  REGION 1..29: note = source = /note="N-term Acetic acid"
SDFYKRLINKAKXXRRQRPRLSHKGXFPX

SEQ ID NO: 95 - protein, 13 aa, synthetic construct
  MOD_RES 2: note = (S)-6-guanidino-2-(methylamino)hexanoic acid
  MOD_RES 4: note = (S)-5-guanidino-2-(methylamino)pentanoic acid; N-alpha-methylarginine
  MOD_RES 5: note = Alpha-methyl-leucine
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term Acetic acid"
QRPRLSHKGPXPF

SEQ ID NO: 96 - protein, 13 aa, synthetic construct
  MOD_RES 1: note = pyroglutamic acid
  MOD_RES 4: note = homo-L-Arginine
  MOD_RES 5: note = Cyclohexylalanine
  MOD_RES 6: note (S)-2-amino-3-(1-(32-amino-3,6,9,12,15,18,21,24,27,30-decao xadotriacontyl)-1H-1,2,3-triazol-4-yl)propanoic acid
  MOD_RES 10: note = octahydroindole-2-carboxylic acid
  MOD_RES 11: note = Norleucine
  MOD_RES 13: note = 4-chloro-L-phenylalanine
  REGION 1..13: note = source = /note="Description of Artificial Sequence: Synthetic peptide"
XRPRXXHKGXXPF

SEQ ID NO: 97 - protein, 17 aa, synthetic construct
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term 3-mercaptopropanoic acid (Methoxypolyethylene glycol amine-N-acetamide (20KDa))"
KFRRQRPRXSHKGXXPF

SEQ ID NO: 98 - protein, 16 aa, synthetic construct
  MOD_RES 7: note = homo-L-Arginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term 3-mercaptopropanoic acid (Methoxypolyethylene glycol amine-N-acetamide (20KDa))"
FRRQRPRXSHKGXXPF

SEQ ID NO: 99 - protein, 15 aa, synthetic construct
  MOD_RES 6: note = homo-L-Arginine
  MOD_RES 7: note = Cyclohexylalanine
  MOD_RES 12: note = octahydroindole-2-carboxylic acid
  MOD_RES 13: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term 3-mercaptopropanoic acid (Methoxypolyethylene glycol amine-N-acetamide (20KDa))"
RRQRPRXSHKGXXPF

SEQ ID NO: 100 - protein, 14 aa, synthetic construct
  MOD_RES 5: note = homo-L-Arginine
  MOD_RES 6: note = Cyclohexylalanine
  MOD_RES 11: note = octahydroindole-2-carboxylic acid
  MOD_RES 12: note = Norleucine
  MOD_RES 14: note = 4-chloro-L-phenylalanine
  REGION 1..14: note = source = /note="Description of Artificial Sequence: Synthetic peptide"
  REGION 1..14: note = source = /note="N-term 3-mercaptopropanoic acid (Methoxypolyethylene glycol amine-N-acetamide (20KDa))"
RQRPRXSHKGXXPF

SEQ ID NO: 101 - protein, 13 aa, synthetic construct
  MOD_RES 4: note = homo-L-Arginine
  MOD_RES 5: note = Cyclohexylalanine
  MOD_RES 10: note = octahydroindole-2-carboxylic acid
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term 3-mercaptopropanoic acid (Methoxypolyethylene glycol amine-N-acetamide (20KDa))"
QRPRXSHKGXXPF

SEQ ID NO: 102 - protein, 17 aa, synthetic construct
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term 1-amino-3,6,9,12,15,18,21,24,27,30,33,36-dodecaoxanonatriac ontan-39-oic acid"
KFRRQRPRXSHKGXXPF

SEQ ID NO: 103 - protein, 15 aa, synthetic construct
  MOD_RES 1: note = homo-L-Arginine
  MOD_RES 2: note = D-Arg
  MOD_RES 4: note = homo-L-Arginine
  MOD_RES 6: note = D-Arg
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term 3-(1H-1,2,3-triazol-4-yl)propanoic acid (Methoxypolyethylene glycol amine-N-acetamide (20KDa))"
RRQRPRLSHKGXFPX

SEQ ID NO: 104 - protein, 15 aa, synthetic construct
  MOD_RES 1: note = homo-L-Arginine
  MOD_RES 4: note = homo-L-Arginine
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term 3-(1H-1,2,3-triazol-4-yl)propanoic acid (Methoxypolyethylene glycol amine-N-acetamide (20KDa))"
RRQRPRLSHKGXFPX

SEQ ID NO: 105 - protein, 18 aa, synthetic construct
  MOD_RES 1: note = 3-(1,2,3-triazol-4-yl)Alanine (Methoxypolyethylene glycol amine-N-acetamide (20KDa))
  MOD_RES 9: note = homo-L-Arginine
  MOD_RES 10: note = Cyclohexylalanine
  MOD_RES 15: note = octahydroindole-2-carboxylic acid
  MOD_RES 16: note = Norleucine
  MOD_RES 18: note = 4-chloro-L-phenylalanine
  REGION 1..18: note = source = /note="Description of Artificial Sequence: Synthetic peptide"
  REGION 1..18: note = source = /note="N-term Acetic acid"
XKFRRQRPRXSHKGXXPF

SEQ ID NO: 106 - protein, 14 aa, synthetic construct
  MOD_RES 1: note = 3-(1,2,3-triazol-4-yl)Alanine (Methoxypolyethylene glycol amine-N-acetamide (20KDa))
  MOD_RES 5: note = homo-L-Arginine
  MOD_RES 6: note = Cyclohexylalanine
  MOD_RES 11: note = octahydroindole-2-carboxylic acid
  MOD_RES 12: note = Norleucine
  MOD_RES 14: note = 4-chloro-L-phenylalanine
  REGION 1..14: note = source = /note="Description of Artificial Sequence: Synthetic peptide"
  REGION 1..14: note = source = /note="N-term Acetic acid"
XLRPRXSHKGXXPF

SEQ ID NO: 107 - protein, 18 aa, synthetic construct
  MOD_RES 1: note = Propargylglycine (Methoxypolyethylene glycol amine-N-acetamide (20KDa))
  MOD_RES 2: note = Ornithine
  MOD_RES 4: note = homo-L-Arginine
  MOD_RES 5: note = homo-L-Arginine
  MOD_RES 9: note = homo-L-Arginine
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Acetic acid"
XXFRRQRPRLSHKGXFPX

SEQ ID NO: 108 - protein, 18 aa, synthetic construct
  MOD_RES 1: note = Propargylglycine (Methoxypolyethylene glycol amine-N-acetamide (20KDa))
  MOD_RES 2: note = Ornithine
  MOD_RES 4: note = homo-L-Arginine
  MOD_RES 5: note = homo-L-Arginine
  MOD_RES 9: note = homo-L-Arginine
  MOD_RES 10: note = N-alpha-methylleucine
  MOD_RES 15: note = octahydroindole-2-carboxylic acid
  MOD_RES 16: note = para-iodophenylalanine
  MOD_RES 18: note = para-iodophenylalanine
  REGION 1..18: note = source = /note="Description of Artificial Sequence: Synthetic peptide"
  REGION 1..18: note = source = /note="N-term Acetic acid"
XXFRRQRPRLSHKGXFPF

SEQ ID NO: 109 - protein, 13 aa, synthetic construct
  MOD_RES 4: note = homo-L-Arginine
  MOD_RES 5: note = Cyclohexylalanine
  MOD_RES 10: note = octahydroindole-2-carboxylic acid
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term Acetic acid(1-amino-3,6,9,12,15,18,21,24,27,30,33,36-dodecaoxanona triacontan-39-oic acid)"
QRPRXSHKGXXPF

SEQ ID NO: 110 - protein, 13 aa, synthetic construct
  REGION 1..13: note = source = /note="Description of Artificial Sequence: Synthetic peptide"
  REGION 1..13: note = source = /note="N-term 3-mercaptopropanoic acid (Methoxypolyethylene glycol amine-N-acetamide (10KDa))"
QRPRLSHKGPMPF

SEQ ID NO: 111 - protein, 13 aa, synthetic construct
  MOD_RES 1: note = D-Gln
  MOD_RES 2: note = homo-L-Arginine
  MOD_RES 4: note = (S)-5-guanidino-2-(methylamino)pentanoic acid; N-alpha-methylarginine
  MOD_RES 5: note = Cyclohexylalanine
  MOD_RES 10: note = octahydroindole-2-carboxylic acid
  MOD_RES 11: note = Norleucine
  MOD_RES 13: note = 4-chloro-D-phenylalanine
  REGION 1..13: note = source = /note="Description of Artificial Sequence: Synthetic peptide"
  REGION 1..13: note = source = /note="N-term 3-mercaptopropanoic acid (Methoxypolyethylene glycol amine-N-acetamide (10KDa))"
QRPRXSHKGXXPF

SEQ ID NO: 112 - protein, 13 aa, synthetic construct
  MOD_RES 2: note = homo-L-Arginine
  MOD_RES 4: note = (S)-5-guanidino-2-(methylamino)pentanoic acid; N-alpha-methylarginine
  MOD_RES 5: note = Alpha-methyl-leucine
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term 3-mercaptopropanoic acid (Methoxypolyethylene glycol amine-N-acetamide (10KDa))"
QRPRLSHKGPXPF

SEQ ID NO: 113 - protein, 13 aa, synthetic construct
  MOD_RES 2: note = homo-L-Arginine
  MOD_RES 4: note = (S)-6-guanidino-2-(methylamino)hexanoic acid
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term 3-mercaptopropanoic acid (Methoxypolyethylene glycol amine-N-acetamide (10KDa))"
QRPRLSHKGPXPF

SEQ ID NO: 114 - protein, 13 aa, synthetic construct
  MOD_RES 3: note = Alpha-methyl-proline
  MOD_RES 4: note = homo-L-Arginine
  MOD_RES 5: note = Alpha-methyl-leucine
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term 3-mercaptopropanoic acid (Methoxypolyethylene glycol amine-N-acetamide (10KDa))"
QRPRLSHKGPXPF

SEQ ID NO: 115 - protein, 13 aa, synthetic construct
  MOD_RES 4: note = (S)-5-guanidino-2-(methylamino)pentanoic acid; N-alpha-methylarginine
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term 3-mercaptopropanoic acid (Methoxypolyethylene glycol amine-N-acetamide (10KDa))"
QRPRLSHKGPXPF

SEQ ID NO: 116 - protein, 13 aa, synthetic construct
  MOD_RES 2: note = (S)-6-guanidino-2-(methylamino)hexanoic acid
  MOD_RES 4: note = (S)-5-guanidino-2-(methylamino)pentanoic acid; N-alpha-methylarginine
  MOD_RES 5: note = Alpha-methyl-leucine
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term 3-mercaptopropanoic acid (Methoxypolyethylene glycol amine-N-acetamide (10KDa))"
QRPRLSHKGPXPF

SEQ ID NO: 117 - protein, 13 aa, synthetic construct
  MOD_RES 4: note = homo-L-Arginine
  MOD_RES 5: note = Alpha-methyl-leucine
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term 3-mercaptopropanoic acid (Methoxypolyethylene glycol amine-N-acetamide (10KDa))"
QRPRLSHKGPXPF

SEQ ID NO: 118 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term para-iodophenylalanine Butanoyl"
XXXQRPRLSHKGPXPF

SEQ ID NO: 119 - protein, 13 aa, synthetic construct
  MOD_RES 2: note = D-Arg
  MOD_RES 4: note = homo-L-Arginine
  MOD_RES 5: note = Alpha-methyl-leucine
  MOD_RES 11: note = Norleucine
  MOD_RES 13: note = 4-chloro-L-phenylalanine
  REGION 1..13: note = source = /note="Description of Artificial Sequence: Synthetic peptide"
  REGION 1..13: note = source = /note="N-term 3-mercaptopropanoic acid (Methoxypolyethylene glycol amine-N-acetamide (10KDa))"
QRPRLSHKGPXPF

SEQ ID NO: 120 - protein, 13 aa, synthetic construct
  MOD_RES 4: note = (S)-5-guanidino-2-(methylamino)pentanoic acid; N-alpha-methylarginine
  MOD_RES 5: note = Cyclohexylalanine
  MOD_RES 10: note = octahydroindole-2-carboxylic acid
  MOD_RES 11: note = Norleucine
  MOD_RES 12: note = Alpha-amino-isobutyric acid
  MOD_RES 13: note = 4-chloro-L-phenylalanine
  REGION 1..13: note = source = /note="Description of Artificial Sequence: Synthetic peptide"
  REGION 1..13: note = source = /note="N-term 3-mercaptopropanoic acid (Methoxypolyethylene glycol amine-N-acetamide (10KDa))"
QRPRXSHKGXXXF

SEQ ID NO: 121 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = octahydroindole-2-carboxylic acid
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 122 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 2-aminoindane-2-carboxylic acid
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 123 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 3-(1-naphthyl)-D-alanine
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 124 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 3-(2-naphthyl)-D-alanine
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 125 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = (R)-2-amino-2-(2,3-dihydro-1H-inden-2-yl)acetic acid
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 126 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = D-Phe
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 127 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 128 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = (R)-1,2,3,4-tetrahydroisoquinoline-3-carboxylic acid
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 129 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-Iodo-D-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 130 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = (R)-1,2,3,4-tetrahydroisoquinoline-3-carboxylic acid
  REGION 1..15: note = source = /note="Description of Artificial Sequence: Synthetic peptide"
  REGION 1..15: note = source = /note="N-term Tridecanoic acid"
XXXQRPRXSHKGXXX

SEQ ID NO: 131 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXXQRPRXSHKGXXF

SEQ ID NO: 132 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 4-chloro-D-phenylalanine
  REGION 1..15: note = source = /note="Description of Artificial Sequence: Synthetic peptide"
  REGION 1..15: note = source = /note="N-term Tridecanoic acid"
XXXQRPRXSHKGXXF

SEQ ID NO: 133 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 2-aminoindane-2-carboxylic acid
  REGION 1..15: note = source = /note="Description of Artificial Sequence: Synthetic peptide"
  REGION 1..15: note = source = /note="N-term Tridecanoic acid"
XXXQRPRXSHKGXXX

SEQ ID NO: 134 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = octahydroindole-2-carboxylic acid
  REGION 1..15: note = source = /note="Description of Artificial Sequence: Synthetic peptide"
  REGION 1..15: note = source = /note="N-term Tridecanoic acid"
XXXQRPRXSHKGXXX

SEQ ID NO: 135 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 4-Iodo-D-phenylalanine
  REGION 1..15: note = source = /note="Description of Artificial Sequence: Synthetic peptide"
  REGION 1..15: note = source = /note="N-term Tridecanoic acid"
XXXQRPRXSHKGXXF

SEQ ID NO: 136 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = (R)-2-amino-2-(2,3-dihydro-1H-inden-2-yl)acetic acid
  REGION 1..15: note = source = /note="Description of Artificial Sequence: Synthetic peptide"
  REGION 1..15: note = source = /note="N-term Tridecanoic acid"
XXXQRPRXSHKGXXX

SEQ ID NO: 137 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = D-Phe
  REGION 1..15: note = source = /note="Description of Artificial Sequence: Synthetic peptide"
  REGION 1..15: note = source = /note="N-term Tridecanoic acid"
XXXQRPRXSHKGXXF

SEQ ID NO: 138 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 3-(1-naphthyl)alanine
  REGION 1..15: note = source = /note="Description of Artificial Sequence: Synthetic peptide"
  REGION 1..15: note = source = /note="N-term Tridecanoic acid"
XXXQRPRXSHKGXXX

SEQ ID NO: 139 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 3-(2-naphthyl)alanine
  REGION 1..15: note = source = /note="Description of Artificial Sequence: Synthetic peptide"
  REGION 1..15: note = source = /note="N-term Tridecanoic acid"
XXXQRPRXSHKGXXX

SEQ ID NO: 140 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 3-(1-naphthyl)-D-alanine
  REGION 1..15: note = source = /note="Description of Artificial Sequence: Synthetic peptide"
  REGION 1..15: note = source = /note="N-term Tridecanoic acid"
XXXQRPRXSHKGXXX

SEQ ID NO: 141 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 3-(2-naphthyl)-D-alanine
  REGION 1..15: note = source = /note="Description of Artificial Sequence: Synthetic peptide"
  REGION 1..15: note = source = /note="N-term Tridecanoic acid"
XXXQRPRXSHKGXXX

SEQ ID NO: 142 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Tridecanoic acid"
XXXQRPRXSHKGXXX

SEQ ID NO: 143 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 1,2,3,4-tetrahydroisoquinoline
  REGION 1..15: note = source = /note="Description of Artificial Sequence: Synthetic peptide"
  REGION 1..15: note = source = /note="N-term Tridecanoic acid"
XXXQRPRXSHKGXXX

SEQ ID NO: 144 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = octahydroindole-2-carboxylic acid
  REGION 1..17: note = source = /note="Description of Artificial Sequence: Synthetic peptide"
  REGION 1..17: note = source = /note="N-term Tridecanoic acid"
XXXRQRPRXSHKGXXPX

SEQ ID NO: 145 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 2-aminoindane-2-carboxylic acid
  REGION 1..17: note = source = /note="Description of Artificial Sequence: Synthetic peptide"
  REGION 1..17: note = source = /note="N-term Tridecanoic acid"
XXXRQRPRXSHKGXXPX

SEQ ID NO: 146 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 3-(1-naphthyl)-D-alanine
  REGION 1..17: note = source = /note="Description of Artificial Sequence: Synthetic peptide"
  REGION 1..17: note = source = /note="N-term Tridecanoic acid"
XXXRQRPRXSHKGXXPX

SEQ ID NO: 147 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 3-(2-naphthyl)-D-alanine
  REGION 1..17: note = source = /note="Description of Artificial Sequence: Synthetic peptide"
  REGION 1..17: note = source = /note="N-term Tridecanoic acid"
XXXRQRPRXSHKGXXPX

SEQ ID NO: 148 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = (R)-2-amino-2-(2,3-dihydro-1H-inden-2-yl)acetic acid
  REGION 1..17: note = source = /note="Description of Artificial Sequence: Synthetic peptide"
  REGION 1..17: note = source = /note="N-term Tridecanoic acid"
XXXRQRPRXSHKGXXPX

SEQ ID NO: 149 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = D-Phe
  REGION 1..17: note = source = /note="Description of Artificial Sequence: Synthetic peptide"
  REGION 1..17: note = source = /note="N-term Tridecanoic acid"
XXXRQRPRXSHKGXXPF

SEQ ID NO: 150 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-D-phenylalanine
  REGION 1..17: note = source = /note="Description of Artificial Sequence: Synthetic peptide"
  REGION 1..17: note = source = /note="N-term Tridecanoic acid"
XXXRQRPRXSHKGXXPF

SEQ ID NO: 151 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = (R)-1,2,3,4-tetrahydroisoquinoline-3-carboxylic acid
  REGION 1..17: note = source = /note="Description of Artificial Sequence: Synthetic peptide"
  REGION 1..17: note = source = /note="N-term Tridecanoic acid"
XXXRQRPRXSHKGXXPX

SEQ ID NO: 152 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 4-Iodo-D-phenylalanine
  REGION 1..17: note = source = /note="Description of Artificial Sequence: Synthetic peptide"
  REGION 1..17: note = source = /note="N-term Tridecanoic acid"
XXXRQRPRXSHKGXXPF

SEQ ID NO: 153 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = octahydroindole-2-carboxylic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 154 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = 4-chloro-D-phenylalanine
  REGION 1..17: note = source = /note="Description of Artificial Sequence: Synthetic peptide"
  REGION 1..17: note = source = /note="N-term Tridecanoic acid"
XXXRQRPRLSHKGXFPF

SEQ ID NO: 155 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = 3-(1-naphthyl)-D-alanine
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 156 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 157 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = Alpha-amino-isobutyric acid
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRXSHKGXXXF

SEQ ID NO: 158 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 2-amino-2-ethylbutanoic acid
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRXSHKGXXXF

SEQ ID NO: 159 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = pipecolic acid
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRXSHKGXXXF

SEQ ID NO: 160 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = pipecolic acid
  MOD_RES 17: note = 4-chloro-D-phenylalanine
  REGION 1..17: note = source = /note="Description of Artificial Sequence: Synthetic peptide"
  REGION 1..17: note = source = /note="N-term Tridecanoic acid"
XXXRQRPRXSHKGXXXF

SEQ ID NO: 161 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 7: note = pipecolic acid
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRXRXSHKGXXPF

SEQ ID NO: 162 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 7: note = pipecolic acid
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = pipecolic acid
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRXRXSHKGXXXF

SEQ ID NO: 163 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 16: note = 3-(1-naphthyl)-D-alanine
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 164 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 3-(1-naphthyl)-D-alanine
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 165 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = D-Arg
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 3-(1-naphthyl)-D-alanine
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 166 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 3-(1-naphthyl)-D-alanine
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 167 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 3-(1-naphthyl)-D-alanine
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 168 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXRQRPRXSHKGXXF

SEQ ID NO: 169 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXRQRPRXSHKGXXF

SEQ ID NO: 170 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = D-Arg
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXRQRPRXSHKGXXF

SEQ ID NO: 171 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXRQRPRXSHKGXXF

SEQ ID NO: 172 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXRQRPRXSHKGXXF

SEQ ID NO: 173 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 16: note = (R)-3-([1,1'-biphenyl]-4-yl)-2-aminopropanoic acid
  REGION 1..16: note = source = /note="Description of Artificial Sequence: Synthetic peptide"
  REGION 1..16: note = source = /note="N-term Tridecanoic acid"
XXXRQRPRLSHKGXFX

SEQ ID NO: 174 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 16: note = (R)-3-([1,1'-biphenyl]-4-yl)-2-aminopropanoic acid
  REGION 1..16: note = source = /note="Description of Artificial Sequence: Synthetic peptide"
  REGION 1..16: note = source = /note="N-term Tridecanoic acid"
XXXRQRPRLSHKGXFX

SEQ ID NO: 175 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = D-Arg
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 16: note = (R)-3-([1,1'-biphenyl]-4-yl)-2-aminopropanoic acid
  REGION 1..16: note = source = /note="Description of Artificial Sequence: Synthetic peptide"
  REGION 1..16: note = source = /note="N-term Tridecanoic acid"
XXXRQRPRLSHKGXFX

SEQ ID NO: 176 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 177 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = D-Arg
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 178 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = D-Arg
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 179 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = Beta-leucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 180 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = Beta-leucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 181 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = D-Arg
  MOD_RES 8: note = D-Arg
  MOD_RES 9: note = Beta-leucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 182 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = (S)-3-cyclohexyl-2-(methylamino)propanoic acid
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRXSHKGXFPX

SEQ ID NO: 183 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 5: note = Beta-leucine
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRLRPRLSHKGXFPX

SEQ ID NO: 184 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = Beta-leucine
  MOD_RES 6: note = D-Arg
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRLRPRLSHKGXFPX

SEQ ID NO: 185 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 5: note = Beta-leucine
  MOD_RES 6: note = D-Arg
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRLRPRLSHKGXFPX

SEQ ID NO: 186 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 5: note = (S)-5-amino-2-(methylamino)-5-oxopentanoic acid
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 187 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 5: note = (S)-5-amino-2-(methylamino)-5-oxopentanoic acid
  MOD_RES 6: note = D-Arg
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 188 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSAKGXFPX

SEQ ID NO: 189 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSYKGXFPX

SEQ ID NO: 190 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 11: note = (S)-tert-butylglycine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSXKGXFPX

SEQ ID NO: 191 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSLKGXFPX

SEQ ID NO: 192 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSVKGXFPX

SEQ ID NO: 193 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 7: note = octahydroindole-2-carboxylic acid
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRXRLSHKGXFPX

SEQ ID NO: 194 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 7: note = Sarcosine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRXRLSHKGXFPX

SEQ ID NO: 195 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 10: note = Beta-homoserine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 196 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 10: note = Beta-alanine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLAHKGXFPX

SEQ ID NO: 197 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 10: note = N-alpha-(2-hydroxyethyl)-glycine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLXHKGXFPX

SEQ ID NO: 198 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 10: note = Alpha-methyl-serine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 199 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSAKGXFPX

SEQ ID NO: 200 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSYKGXFPX

SEQ ID NO: 201 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = N-alpha-methylleucine
  MOD_RES 11: note = (S)-tert-butylglycine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSXKGXFPX

SEQ ID NO: 202 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = N-alpha-methylleucine
  MOD_RES 11: note = 2-amino-2-ethylbutanoic acid
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSXKGXFPX

SEQ ID NO: 203 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSLKGXFPX

SEQ ID NO: 204 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSVKGXFPX

SEQ ID NO: 205 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 7: note = octahydroindole-2-carboxylic acid
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRXRLSHKGXFPX

SEQ ID NO: 206 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 7: note = Sarcosine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRXRLSHKGXFPX

SEQ ID NO: 207 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = N-alpha-methylleucine
  MOD_RES 10: note = Beta-homoserine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 208 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = N-alpha-methylleucine
  MOD_RES 10: note = Beta-alanine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLAHKGXFPX

SEQ ID NO: 209 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = N-alpha-methylleucine
  MOD_RES 10: note = N-alpha-(2-hydroxyethyl)-glycine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLXHKGXFPX

SEQ ID NO: 210 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = N-alpha-methylleucine
  MOD_RES 10: note = Alpha-methyl-serine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 211 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 212 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 8: note = homo-L-Arginine
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 213 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 8: note = homo-L-Arginine
  MOD_RES 9: note = N-alpha-methylleucine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 214 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 8: note = homo-L-Arginine
  MOD_RES 9: note = Cyclohexylalanine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRXSHKGXFPX

SEQ ID NO: 215 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 8: note = D-Arg
  MOD_RES 9: note = Cyclohexylalanine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRXSHKGXFPX

SEQ ID NO: 216 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 8: note = D-Arg
  MOD_RES 9: note = Cyclohexylalanine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRXSHKGXFPX

SEQ ID NO: 217 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 8: note = homo-L-Arginine
  MOD_RES 9: note = Cyclohexylalanine
  MOD_RES 14: note = octahydroindole-2-carboxylic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRXSHKGXFPX

SEQ ID NO: 218 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRLSHKGXXPF

SEQ ID NO: 219 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = para-iodophenylalanine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRLSHKGXFPF

SEQ ID NO: 220 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = Norleucine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXXPX

SEQ ID NO: 221 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = D-Arg
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRXSHKGXXPF

SEQ ID NO: 222 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = homo-L-Arginine
  MOD_RES 8: note = N-alpha-methylleucine
  MOD_RES 13: note = octahydroindole-2-carboxylic acid
  MOD_RES 14: note = para-iodophenylalanine
  MOD_RES 16: note = (R)-3-([1,1'-biphenyl]-4-yl)-2-aminopropanoic acid
  REGION 1..16: note = source = /note="Description of Artificial Sequence: Synthetic peptide"
  REGION 1..16: note = source = /note="N-term Tridecanoic acid"
XXXQRPRLSHKGXFPX

SEQ ID NO: 223 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = homo-L-Arginine
  MOD_RES 8: note = Cyclohexylalanine
  MOD_RES 13: note = octahydroindole-2-carboxylic acid
  MOD_RES 14: note = para-iodophenylalanine
  MOD_RES 16: note = (R)-3-([1,1'-biphenyl]-4-yl)-2-aminopropanoic acid
  REGION 1..16: note = source = /note="Description of Artificial Sequence: Synthetic peptide"
  REGION 1..16: note = source = /note="N-term Tridecanoic acid"
XXXQRPRXSHKGXFPX

SEQ ID NO: 224 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = D-Arg
  MOD_RES 8: note = Cyclohexylalanine
  MOD_RES 13: note = octahydroindole-2-carboxylic acid
  MOD_RES 14: note = para-iodophenylalanine
  MOD_RES 16: note = (R)-3-([1,1'-biphenyl]-4-yl)-2-aminopropanoic acid
  REGION 1..16: note = source = /note="Description of Artificial Sequence: Synthetic peptide"
  REGION 1..16: note = source = /note="N-term Tridecanoic acid"
XXXQRPRXSHKGXFPX

SEQ ID NO: 225 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = D-Arg
  MOD_RES 8: note = N-alpha-methylleucine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 226 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = D-Arg
  MOD_RES 8: note = N-alpha-methylleucine
  MOD_RES 13: note = octahydroindole-2-carboxylic acid
  MOD_RES 14: note = para-iodophenylalanine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXFPF

SEQ ID NO: 227 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = D-Arg
  MOD_RES 8: note = N-alpha-methylleucine
  MOD_RES 13: note = octahydroindole-2-carboxylic acid
  MOD_RES 14: note = Norleucine
  MOD_RES 16: note = (R)-3-([1,1'-biphenyl]-4-yl)-2-aminopropanoic acid
  REGION 1..16: note = source = /note="Description of Artificial Sequence: Synthetic peptide"
  REGION 1..16: note = source = /note="N-term Tridecanoic acid"
XXXQRPRLSHKGXXPX

SEQ ID NO: 228 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 229 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = D-Arg
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRXSHKGXXPF

SEQ ID NO: 230 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = D-Arg
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-D-phenylalanine
  REGION 1..17: note = source = /note="Description of Artificial Sequence: Synthetic peptide"
  REGION 1..17: note = source = /note="N-term Tridecanoic acid"
XXXRQRPRXSHKGXXPF

SEQ ID NO: 231 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = [2-(2-Amino-ethoxy)-ethoxy]-acetic acid
  MOD_RES 6: note = D-Arg
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXXQRPRXSHKGXXPF

SEQ ID NO: 232 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = [2-(2-Amino-ethoxy)-ethoxy]-acetic acid
  MOD_RES 6: note = D-Arg
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-D-phenylalanine
  REGION 1..17: note = source = /note="Description of Artificial Sequence: Synthetic peptide"
  REGION 1..17: note = source = /note="N-term Tridecanoic acid"
XXXXQRPRXSHKGXXPF

SEQ ID NO: 233 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = [2-(2-Amino-ethoxy)-ethoxy]-acetic acid
  MOD_RES 6: note = D-Arg
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 3-(1-naphthyl)-D-alanine
  REGION 1..16: note = source = /note="Description of Artificial Sequence: Synthetic peptide"
  REGION 1..16: note = source = /note="N-term Tridecanoic acid"
XXXXQRPRXSHKGXXX

SEQ ID NO: 234 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = pipecolic acid
  MOD_RES 16: note = 4-chloro-L-phenylalanine
  REGION 1..16: note = source = /note="Description of Artificial Sequence: Synthetic peptide"
  REGION 1..16: note = source = /note="N-term Heptadecanoic acid"
XXXQRPRXSHKGXXXF

SEQ ID NO: 235 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = N-alpha-methylleucine
  MOD_RES 13: note = octahydroindole-2-carboxylic acid
  MOD_RES 14: note = Norleucine
  MOD_RES 16: note = D-Phe
  REGION 1..16: note = source = /note="Description of Artificial Sequence: Synthetic peptide"
  REGION 1..16: note = source = /note="N-term Heptadecanoic acid"
XXXQRPRLSHKGXXPF

SEQ ID NO: 236 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Heptadecanoic acid"
XXXQRPRXSHKGXXPF

SEQ ID NO: 237 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Heptadecanoic acid"
XXXQRPRXSHKGXXPF

SEQ ID NO: 238 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 1,2,3,4-tetrahydroisoquinoline
  REGION 1..16: note = source = /note="Description of Artificial Sequence: Synthetic peptide"
  REGION 1..16: note = source = /note="N-term Heptadecanoic acid"
XXXQRPRXSHKGXXPX

SEQ ID NO: 239 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = D-Arg
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = pipecolic acid
  MOD_RES 17: note = 4-chloro-L-phenylalanine
  REGION 1..17: note = source = /note="Description of Artificial Sequence: Synthetic peptide"
  REGION 1..17: note = source = /note="N-term Heptadecanoic acid"
XXXRQRPRXSHKGXXXF

SEQ ID NO: 240 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = D-Arg
  MOD_RES 9: note = N-alpha-methylleucine
  MOD_RES 14: note = octahydroindole-2-carboxylic acid
  MOD_RES 15: note = Norleucine
  MOD_RES 17: note = D-Phe
  REGION 1..17: note = source = /note="Description of Artificial Sequence: Synthetic peptide"
  REGION 1..17: note = source = /note="N-term Heptadecanoic acid"
XXXRQRPRLSHKGXXPF

SEQ ID NO: 241 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Heptadecanoic acid"
XXXRQRPRXSHKGXXPF

SEQ ID NO: 242 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-D-phenylalanine
  REGION 1..17: note = source = /note="Description of Artificial Sequence: Synthetic peptide"
  REGION 1..17: note = source = /note="N-term Heptadecanoic acid"
XXXRQRPRXSHKGXXPF

SEQ ID NO: 243 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = D-Arg
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 1,2,3,4-tetrahydroisoquinoline
  REGION 1..17: note = source = /note="Description of Artificial Sequence: Synthetic peptide"
  REGION 1..17: note = source = /note="N-term Heptadecanoic acid"
XXXRQRPRXSHKGXXPX

SEQ ID NO: 244 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 1,2,3,4-tetrahydroisoquinoline
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 245 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = (R)-1,2,3,4-tetrahydroisoquinoline-3-carboxylic acid
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 246 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXRQRPRXSHKGXXF

SEQ ID NO: 247 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 2-aminoindane-2-carboxylic acid
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 248 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = octahydroindole-2-carboxylic acid
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 249 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 4-Iodo-D-phenylalanine
  REGION 1..16: note = source = /note="Description of Artificial Sequence: Synthetic peptide"
  REGION 1..16: note = source = /note="N-term Tridecanoic acid"
XXXRQRPRXSHKGXXF

SEQ ID NO: 250 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = (R)-2-amino-2-(2,3-dihydro-1H-inden-2-yl)acetic acid
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 251 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = D-Phe
  REGION 1..16: note = source = /note="Description of Artificial Sequence: Synthetic peptide"
  REGION 1..16: note = source = /note="N-term Tridecanoic acid"
XXXRQRPRXSHKGXXF

SEQ ID NO: 252 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 3-(1-naphthyl)alanine
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 253 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 3-(2-naphthyl)alanine
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 254 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 3-(2-naphthyl)-D-alanine
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 255 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = (R)-3-([1,1'-biphenyl]-4-yl)-2-aminopropanoic acid
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 256 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 1,2,3,4-tetrahydroisoquinoline
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 257 - protein, 19 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Ornithine
  MOD_RES 6: note = homo-L-Arginine
  MOD_RES 7: note = homo-L-Arginine
  MOD_RES 11: note = homo-L-Arginine
  MOD_RES 12: note = N-alpha-methylleucine
  MOD_RES 17: note = octahydroindole-2-carboxylic acid
  MOD_RES 18: note = Norleucine
  MOD_RES 19: note = 3-(2-naphthyl)alanine
  REGION 1..19: note = source = /note="Description of Artificial Sequence: Synthetic peptide"
  REGION 1..19: note = source = /note="N-term Tridecanoic acid"
XXXXFRRQRPRLSHKGXXX

SEQ ID NO: 258 - protein, 19 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Ornithine
  MOD_RES 6: note = homo-L-Arginine
  MOD_RES 7: note = homo-L-Arginine
  MOD_RES 11: note = homo-L-Arginine
  MOD_RES 12: note = N-alpha-methylleucine
  MOD_RES 17: note = octahydroindole-2-carboxylic acid
  MOD_RES 18: note = Norleucine
  MOD_RES 19: note = 3-(2-naphthyl)alanine
  REGION 1..19: note = source = /note="Description of Artificial Sequence: Synthetic peptide"
  REGION 1..19: note = source = /note="N-term Pentadecanoic acid"
XXXXFRRQRPRLSHKGXXX

SEQ ID NO: 259 - protein, 19 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Ornithine
  MOD_RES 6: note = homo-L-Arginine
  MOD_RES 7: note = homo-L-Arginine
  MOD_RES 11: note = homo-L-Arginine
  MOD_RES 12: note = N-alpha-methylleucine
  MOD_RES 17: note = octahydroindole-2-carboxylic acid
  MOD_RES 18: note = Norleucine
  MOD_RES 19: note = 3-(2-naphthyl)alanine
  REGION 1..19: note = source = /note="Description of Artificial Sequence: Synthetic peptide"
  REGION 1..19: note = source = /note="N-term Heptadecanoic acid"
XXXXFRRQRPRLSHKGXXX

SEQ ID NO: 260 - protein, 19 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Ornithine
  MOD_RES 6: note = homo-L-Arginine
  MOD_RES 7: note = homo-L-Arginine
  MOD_RES 11: note = homo-L-Arginine
  MOD_RES 12: note = N-alpha-methylleucine
  MOD_RES 17: note = octahydroindole-2-carboxylic acid
  MOD_RES 18: note = Norleucine
  MOD_RES 19: note = 3-(2-naphthyl)alanine
  REGION 1..19: note = source = /note="Description of Artificial Sequence: Synthetic peptide"
  REGION 1..19: note = source = /note="N-term Octadecandioic acid"
XXXXFRRQRPRLSHKGXXX

SEQ ID NO: 261 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQRPRLSHKGXFPX

SEQ ID NO: 262 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Pentadecanoic acid"
XXXRRQRPRLSHKGXFPX

SEQ ID NO: 263 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Heptadecanoic acid"
XXXRRQRPRLSHKGXFPX

SEQ ID NO: 264 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Octadecandioic acid"
XXXRRQRPRLSHKGXFPX

SEQ ID NO: 265 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 266 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 267 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 268 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 3-(1-naphthyl)-D-alanine
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 269 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = (R)-1,2,3,4-tetrahydroisoquinoline-3-carboxylic acid
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 270 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXXF

SEQ ID NO: 271 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 15: note = 2-amino-2-ethylbutanoic acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXXF

SEQ ID NO: 272 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = (S)-tert-butylglycine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 273 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 10: note = Alpha-amino-isobutyric acid
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSXKGXXPF

SEQ ID NO: 274 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Beta-leucine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 275 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Beta-leucine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 276 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = (S)-3-cyclohexyl-2-(methylamino)propanoic acid
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 277 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Leu
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXLRPRXSHKGXXPF

SEQ ID NO: 278 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Beta-leucine
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXLRPRXSHKGXXPF

SEQ ID NO: 279 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = (S)-5-guanidino-2-(methylamino)pentanoic acid; N-alpha-methylarginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 280 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = (S)-5-guanidino-2-(methylamino)pentanoic acid; N-alpha-methylarginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 281 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Beta-leucine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 282 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXXQRPRXSHKGXXF

SEQ ID NO: 283 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 15: note = 4-chloro-D-phenylalanine
  REGION 1..15: note = source = /note="Description of Artificial Sequence: Synthetic peptide"
  REGION 1..15: note = source = /note="N-term Tridecanoic acid"
XXXQRPRXSHKGXXF

SEQ ID NO: 284 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 285 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 3-(1-naphthyl)-D-alanine
  REGION 1..15: note = source = /note="Description of Artificial Sequence: Synthetic peptide"
  REGION 1..15: note = source = /note="N-term Tridecanoic acid"
XXXQRPRXSHKGXXX

SEQ ID NO: 286 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term hexanoyl"
XXXRRQRPRLSHKGXFPX

SEQ ID NO: 287 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 288 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = D-Arg
  MOD_RES 8: note = N-alpha-methylleucine
  MOD_RES 13: note = octahydroindole-2-carboxylic acid
  MOD_RES 14: note = para-iodophenylalanine
  MOD_RES 16: note = (R)-3-([1,1'-biphenyl]-4-yl)-2-aminopropanoic acid
  REGION 1..16: note = source = /note="Description of Artificial Sequence: Synthetic peptide"
  REGION 1..16: note = source = /note="N-term Sebacicacid"
XXXQRPRLSHKGXFPX

SEQ ID NO: 289 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Sebacicacid"
XXXRRQRPRLSHKGXFPX

SEQ ID NO: 290 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  REGION 1..16: note = source = /note="Description of Artificial Sequence: Synthetic peptide"
  REGION 1..16: note = source = /note="N-term Octadecandioic acid"
XXXQRPRLSHKGPMPF

SEQ ID NO: 291 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Sebacicacid"
XXXRRQRPRLSHKGXFPX

SEQ ID NO: 292 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Leu
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXLRPRXSHKGXXPF

SEQ ID NO: 293 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 11: note = Beta-alanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXSHAGXXPF

SEQ ID NO: 294 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 12: note = Beta-alanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXSHKAXXPF

SEQ ID NO: 295 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Beta-alanine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXAF

SEQ ID NO: 296 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Beta-homoproline
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 297 - protein, 20 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Ornithine
  MOD_RES 6: note = homo-L-Arginine
  MOD_RES 7: note = homo-L-Arginine
  MOD_RES 9: note = (S)-5-guanidino-2-(methylamino)pentanoic acid; N-alpha-methylarginine
  MOD_RES 11: note = (S)-5-guanidino-2-(methylamino)pentanoic acid; N-alpha-methylarginine
  MOD_RES 12: note = Cyclohexylalanine
  MOD_RES 17: note = octahydroindole-2-carboxylic acid
  MOD_RES 18: note = Norleucine
  MOD_RES 20: note = 4-chloro-L-phenylalanine
  REGION 1..20: note = source = /note="Description of Artificial Sequence: Synthetic peptide"
  REGION 1..20: note = source = /note="N-term Tridecanoic acid"
XXXXFRRQRPRXSHKGXXPF

SEQ ID NO: 298 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Beta-leucine
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXLRPRXSHKGXXPF

SEQ ID NO: 299 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Beta-homoasparagine
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXNRPRXSHKGXXPF

SEQ ID NO: 300 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Beta-homoleucine
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXLRPRXSHKGXXPF

SEQ ID NO: 301 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 6: note = Beta-homoproline
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 302 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Beta-homoleucine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 303 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 9: note = Beta-alanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXAHKGXXPF

SEQ ID NO: 304 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 10: note = Beta-alanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXSAKGXXPF

SEQ ID NO: 305 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 11: note = 3-pyridinylalanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXSHXGXXPF

SEQ ID NO: 306 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 11: note = Beta-lysine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 307 - protein, 20 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Ornithine
  MOD_RES 6: note = homo-L-Arginine
  MOD_RES 7: note = homo-L-Arginine
  MOD_RES 8: note = Beta-leucine
  MOD_RES 9: note = homo-L-Arginine
  MOD_RES 11: note = homo-L-Arginine
  MOD_RES 12: note = Cyclohexylalanine
  MOD_RES 17: note = octahydroindole-2-carboxylic acid
  MOD_RES 18: note = Norleucine
  MOD_RES 20: note = 4-chloro-L-phenylalanine
  REGION 1..20: note = source = /note="Description of Artificial Sequence: Synthetic peptide"
  REGION 1..20: note = source = /note="N-term Tridecanoic acid"
XXXXFRRLRPRXSHKGXXPF

SEQ ID NO: 308 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = homo-L-Arginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 309 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = homo-L-Arginine
  MOD_RES 7: note = homo-L-Arginine
  MOD_RES 9: note = (S)-5-guanidino-2-(methylamino)pentanoic acid; N-alpha-methylarginine
  MOD_RES 10: note = Cyclohexylalanine
  MOD_RES 15: note = octahydroindole-2-carboxylic acid
  MOD_RES 16: note = Norleucine
  MOD_RES 18: note = 4-chloro-L-phenylalanine
  REGION 1..18: note = source = /note="Description of Artificial Sequence: Synthetic peptide"
  REGION 1..18: note = source = /note="N-term Tridecanoic acid"
XXXRRQRPRXSHKGXXPF

SEQ ID NO: 310 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRXSHKGXXPF

SEQ ID NO: 311 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = Norleucine
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQRPXLSHKGXFPX

SEQ ID NO: 312 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 13: note = Norleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQRPRLSHXGXFPX

SEQ ID NO: 313 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 10: note = N-alpha-methylleucine
  MOD_RES 13: note = Norleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQRPKLSHXGXFPX

SEQ ID NO: 314 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Norleucine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXXRQRPRLSHKGXFPX

SEQ ID NO: 315 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = Norleucine
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRXQRPRLSHKGXFPX

SEQ ID NO: 316 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = Norleucine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQXPRLSHKGXFPX

SEQ ID NO: 317 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = Norleucine
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQRPXLAHKGXFPX

SEQ ID NO: 318 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 13: note = Norleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQRPRLAHXGXFPX

SEQ ID NO: 319 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 10: note = N-alpha-methylleucine
  MOD_RES 13: note = Norleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQRPKLAHXGXFPX

SEQ ID NO: 320 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Norleucine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXXRQRPRLAHKGXFPX

SEQ ID NO: 321 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = Norleucine
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRXQRPRLAHKGXFPX

SEQ ID NO: 322 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = Norleucine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQXPRLAHKGXFPX

SEQ ID NO: 323 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = Norleucine
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQRPXLSAKGXFPX

SEQ ID NO: 324 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 13: note = Norleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQRPRLSAXGXFPX

SEQ ID NO: 325 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 10: note = N-alpha-methylleucine
  MOD_RES 13: note = Norleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQRPKLSAXGXFPX

SEQ ID NO: 326 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Norleucine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXXRQRPRLSAKGXFPX

SEQ ID NO: 327 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = Norleucine
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRXQRPRLSAKGXFPX

SEQ ID NO: 328 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = Norleucine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQXPRLSAKGXFPX

SEQ ID NO: 329 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = Norleucine
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQRPXLAAKGXFPX

SEQ ID NO: 330 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 13: note = Norleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQRPRLAAXGXFPX

SEQ ID NO: 331 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 10: note = N-alpha-methylleucine
  MOD_RES 13: note = Norleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQRPKLAAXGXFPX

SEQ ID NO: 332 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Norleucine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXXRQRPRLAAKGXFPX

SEQ ID NO: 333 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = Norleucine
  MOD_RES 7: note = homo-L-Arginine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRXQRPRLAAKGXFPX

SEQ ID NO: 334 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = Norleucine
  MOD_RES 9: note = D-Arg
  MOD_RES 10: note = N-alpha-methylleucine
  MOD_RES 15: note = octahydroindole-2-carboxylic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term Tridecanoic acid"
XXXRRQXPRLAAKGXFPX

SEQ ID NO: 335 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 8: note = Norleucine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPXXSHKGXXPF

SEQ ID NO: 336 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 8: note = homo-L-Arginine
  MOD_RES 9: note = Cyclohexylalanine
  MOD_RES 12: note = Norleucine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRXSHXGXXPF

SEQ ID NO: 337 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 9: note = Cyclohexylalanine
  MOD_RES 12: note = Norleucine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPKXSHXGXXPF

SEQ ID NO: 338 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Norleucine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXXQRPRXSHKGXXPF

SEQ ID NO: 339 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 6: note = Norleucine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQXPRXSHKGXXPF

SEQ ID NO: 340 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 8: note = homo-L-Arginine
  MOD_RES 9: note = Cyclohexylalanine
  MOD_RES 12: note = Norleucine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRXSAXGXXPF

SEQ ID NO: 341 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 9: note = Cyclohexylalanine
  MOD_RES 12: note = Norleucine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPKXSAXGXXPF

SEQ ID NO: 342 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Norleucine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXXQRPRXSAKGXXPF

SEQ ID NO: 343 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 6: note = Norleucine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQXPRXSAKGXXPF

SEQ ID NO: 344 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 8: note = Norleucine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPXXAHKGXXPF

SEQ ID NO: 345 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 8: note = Norleucine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPXXAAKGXXPF

SEQ ID NO: 346 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 9: note = Cyclohexylalanine
  MOD_RES 12: note = Norleucine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPKXAAXGXXPF

SEQ ID NO: 347 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Norleucine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXXQRPRXAAKGXXPF

SEQ ID NO: 348 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 6: note = Norleucine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQXPRXAAKGXXPF

SEQ ID NO: 349 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = D-Arg
  MOD_RES 8: note = N-alpha-methylleucine
  MOD_RES 13: note = octahydroindole-2-carboxylic acid
  MOD_RES 14: note = para-iodophenylalanine
  MOD_RES 16: note = (R)-3-([1,1'-biphenyl]-4-yl)-2-aminopropanoic acid
  REGION 1..16: note = source = /note="Description of Artificial Sequence: Synthetic peptide"
  REGION 1..16: note = source = /note="N-term Dodecanedioic acid"
XXXQRPRLSHKGXFPX

SEQ ID NO: 350 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 8: note = Norleucine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPXXSAKGXXPF

SEQ ID NO: 351 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 8: note = homo-L-Arginine
  MOD_RES 9: note = Cyclohexylalanine
  MOD_RES 12: note = Norleucine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRXAAXGXXPF

SEQ ID NO: 352 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 353 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 354 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = (S)-5-guanidino-2-(methylamino)pentanoic acid; N-alpha-methylarginine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 355 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = homo-L-Arginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 356 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = homo-L-Arginine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 357 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = homo-L-Arginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 358 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = homo-L-Arginine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 359 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = (S)-5-guanidino-2-(methylamino)pentanoic acid; N-alpha-methylarginine
  MOD_RES 8: note = Alpha-methyl-leucine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 360 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = homo-L-Arginine
  MOD_RES 8: note = Alpha-methyl-leucine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 361 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGPXPF

SEQ ID NO: 362 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 363 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 364 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 365 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = octahydroindole-2-carboxylic acid
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 366 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 2-aminoindane-2-carboxylic acid
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 367 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 3-(1-naphthyl)alanine
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 368 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 3-(2-naphthyl)alanine
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 369 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-Iodo-D-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 370 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = Beta-4-chloro-L-homophenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 371 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 12: note = (S)-tert-butylglycine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKXXXPF

SEQ ID NO: 372 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSAKGXXPF

SEQ ID NO: 373 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSYKGXXPF

SEQ ID NO: 374 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Beta-leucine
  MOD_RES 7: note = (S)-5-guanidino-2-(methylamino)pentanoic acid; N-alpha-methylarginine
  MOD_RES 8: note = Alpha-methyl-leucine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXLRPRLSHKGXXPF

SEQ ID NO: 375 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Alpha-methyl-leucine
  MOD_RES 7: note = (S)-5-guanidino-2-(methylamino)pentanoic acid; N-alpha-methylarginine
  MOD_RES 8: note = Alpha-methyl-leucine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXLRPRLSHKGXXPF

SEQ ID NO: 376 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Alpha-methyl-leucine
  MOD_RES 13: note = octahydroindole-2-carboxylic acid
  MOD_RES 14: note = Norleucine
  MOD_RES 15: note = Alpha-methyl-proline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 377 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 378 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = homo-L-Arginine
  MOD_RES 8: note = Beta-leucine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 379 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = Beta-homophenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 380 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = Beta-homo-D-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 381 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 382 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXXF

SEQ ID NO: 383 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = (S)-5-guanidino-2-(methylamino)pentanoic acid; N-alpha-methylarginine
  MOD_RES 8: note = Beta-leucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 384 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = (S)-6-guanidino-2-(methylamino)hexanoic acid
  MOD_RES 8: note = Beta-leucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 385 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Alpha-methyl-leucine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 386 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 387 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Alpha-methyl-leucine
  MOD_RES 13: note = Alpha-methyl-proline
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 388 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Beta-leucine
  MOD_RES 7: note = (S)-5-guanidino-2-(methylamino)pentanoic acid; N-alpha-methylarginine
  MOD_RES 8: note = Alpha-methyl-leucine
  MOD_RES 13: note = octahydroindole-2-carboxylic acid
  MOD_RES 14: note = Norleucine
  MOD_RES 15: note = Alpha-methyl-proline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXLRPRLSHKGXXPF

SEQ ID NO: 389 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Alpha-methyl-leucine
  MOD_RES 13: note = octahydroindole-2-carboxylic acid
  MOD_RES 14: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXXQRPRLSHKGXXF

SEQ ID NO: 390 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 391 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Beta-leucine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 392 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 6: note = Alpha-methyl-proline
  MOD_RES 7: note = homo-L-Arginine
  MOD_RES 8: note = Beta-leucine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 393 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Beta-leucine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXLRPRXSHKGXXPF

SEQ ID NO: 394 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Beta-leucine
  MOD_RES 7: note = (S)-5-guanidino-2-(methylamino)pentanoic acid; N-alpha-methylarginine
  MOD_RES 8: note = Beta-leucine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXLRPRLSHKGXXPF

SEQ ID NO: 395 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Beta-leucine
  MOD_RES 7: note = homo-L-Arginine
  MOD_RES 8: note = Beta-leucine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXLRPRLSHKGXXPF

SEQ ID NO: 396 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 6: note = (S)-5-guanidino-2-(methylamino)pentanoic acid; N-alpha-methylarginine
  MOD_RES 7: note = Alpha-methyl-leucine
  MOD_RES 12: note = octahydroindole-2-carboxylic acid
  MOD_RES 13: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXXQRRLSHKGXXPF

SEQ ID NO: 397 - protein, 14 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = (S)-5-guanidino-2-(methylamino)pentanoic acid; N-alpha-methylarginine
  MOD_RES 6: note = Alpha-methyl-leucine
  MOD_RES 11: note = octahydroindole-2-carboxylic acid
  MOD_RES 12: note = Norleucine
  MOD_RES 14: note = 4-chloro-L-phenylalanine
  REGION 1..14: note = source = /note="Description of Artificial Sequence: Synthetic peptide"
  REGION 1..14: note = source = /note="N-term Tridecanoic acid"
XXXQRLSHKGXXPF

SEQ ID NO: 398 - protein, 20 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = [2-(2-Amino-ethoxy)-ethoxy]-acetic acid
  MOD_RES 5: note = [2-(2-Amino-ethoxy)-ethoxy]-acetic acid
  MOD_RES 6: note = [2-(2-Amino-ethoxy)-ethoxy]-acetic acid
  MOD_RES 7: note = [2-(2-Amino-ethoxy)-ethoxy]-acetic acid
  MOD_RES 11: note = (S)-5-guanidino-2-(methylamino)pentanoic acid; N-alpha-methylarginine
  MOD_RES 18: note = Norleucine
  MOD_RES 20: note = 4-chloro-L-phenylalanine
  REGION 1..20: note = source = /note="Description of Artificial Sequence: Synthetic peptide"
  REGION 1..20: note = source = /note="N-term Tridecanoic acid"
XXXXXXXQRPRLSHKGPXPF

SEQ ID NO: 399 - protein, 17 aa, synthetic construct
  MOD_RES 1: note = Alpha-carboxy-4-aminobutyric acid
  MOD_RES 2: note = Alpha-carboxy-4-aminobutyric acid
  MOD_RES 3: note = [2-(2-Amino-ethoxy)-ethoxy]-acetic acid
  MOD_RES 4: note = [2-(2-Amino-ethoxy)-ethoxy]-acetic acid
  MOD_RES 8: note = (S)-5-guanidino-2-(methylamino)pentanoic acid; N-alpha-methylarginine
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXXQRPRLSHKGPXPF

SEQ ID NO: 400 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = Citrulline
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQXPRLSHKGPXPF

SEQ ID NO: 401 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 15: note = Alpha-methyl-proline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 402 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXXQRPRLSHKGPXF

SEQ ID NO: 403 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 15: note = 3-(2-naphthyl)alanine
  REGION 1..15: note = source = /note="Description of Artificial Sequence: Synthetic peptide"
  REGION 1..15: note = source = /note="N-term Tridecanoic acid"
XXXQRPRLSHKGPXX

SEQ ID NO: 404 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = homo-L-Arginine
  MOD_RES 8: note = Alpha-methyl-leucine
  MOD_RES 14: note = Norleucine
  MOD_RES 16: note = 3-(2-naphthyl)alanine
  REGION 1..16: note = source = /note="Description of Artificial Sequence: Synthetic peptide"
  REGION 1..16: note = source = /note="N-term Tridecanoic acid"
XXXQRPRLSHKGPXPX

SEQ ID NO: 405 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 3-(2-naphthyl)alanine
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 406 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = Cyclopentylglycine
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 407 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 3-(2-naphthyl)-D-alanine
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 408 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGPXPF

SEQ ID NO: 409 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXXQRPRXSHKGXXF

SEQ ID NO: 410 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 4-chloro-D-phenylalanine
  REGION 1..15: note = source = /note="Description of Artificial Sequence: Synthetic peptide"
  REGION 1..15: note = source = /note="N-term Tridecanoic acid"
XXXQRPRXSHKGXXF

SEQ ID NO: 411 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 2-amino-2-ethylbutanoic acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXXF

SEQ ID NO: 412 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-methyl-proline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 413 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = (S)-tert-butylglycine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 414 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = Alpha-amino-isobutyric acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 415 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = 2-amino-2-ethylbutanoic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 416 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 417 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = Beta-homoproline
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGPXPF

SEQ ID NO: 418 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = Alpha-methyl-proline
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGPXPF

SEQ ID NO: 419 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSAKGXXPF

SEQ ID NO: 420 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Beta-homoasparagine
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXNRPRLSHKGPXPF

SEQ ID NO: 421 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Beta-homoleucine
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXLRPRLSHKGPXPF

SEQ ID NO: 422 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Beta-homoleucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 423 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 10: note = Beta-alanine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSAKGPXPF

SEQ ID NO: 424 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 11: note = Beta-alanine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHAGPXPF

SEQ ID NO: 425 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 15: note = Beta-alanine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXAF

SEQ ID NO: 426 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 427 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPPLSHKGPXPF

SEQ ID NO: 428 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = Norleucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPXLSHKGPXPF

SEQ ID NO: 429 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 15: note = pipecolic acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXXF

SEQ ID NO: 430 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 431 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = (R)-2-amino-2-(2,3-dihydro-1H-inden-2-yl)acetic acid
  REGION 1..16: note = source = /note="Description of Artificial Sequence: Synthetic peptide"
  REGION 1..16: note = source = /note="N-term Tridecanoic acid"
XXXQRPRXSHKGXXPX

SEQ ID NO: 432 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = Beta-4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 433 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = (S)-tert-butylglycine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 434 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = 2-amino-2-ethylbutanoic acid
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 435 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = (S)-6-guanidino-2-(methylamino)hexanoic acid
  MOD_RES 8: note = Cyclohexylalanine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGPXPF

SEQ ID NO: 436 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSYKGXXPF

SEQ ID NO: 437 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSVKGXXPF

SEQ ID NO: 438 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 10: note = (S)-tert-butylglycine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSXKGXXPF

SEQ ID NO: 439 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = (S)-tert-butylglycine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 440 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 6: note = pipecolic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRXRXSHKGXXPF

SEQ ID NO: 441 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 6: note = Beta-homoproline
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 442 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = (S)-tert-butylglycine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXXRPRXSHKGXXPF

SEQ ID NO: 443 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = 2-amino-2-ethylbutanoic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXXRPRXSHKGXXPF

SEQ ID NO: 444 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 11: note = Alpha-methyl-lysine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 445 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = pipecolic acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXXF

SEQ ID NO: 446 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 6: note = (S)-5-guanidino-2-(methylamino)pentanoic acid; N-alpha-methylarginine
  MOD_RES 7: note = Cyclohexylalanine
  MOD_RES 12: note = octahydroindole-2-carboxylic acid
  MOD_RES 13: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXXQRRXSHKGXXPF

SEQ ID NO: 447 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 6: note = (S)-5-guanidino-2-(methylamino)pentanoic acid; N-alpha-methylarginine
  MOD_RES 7: note = Beta-leucine
  MOD_RES 12: note = octahydroindole-2-carboxylic acid
  MOD_RES 13: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXXQRRLSHKGXXPF

SEQ ID NO: 448 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHHGPXPF

SEQ ID NO: 449 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 11: note = 3-(1-naphthyl)alanine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHXGPXPF

SEQ ID NO: 450 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 9: note = Propargylglycine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLXHKGPXPF

SEQ ID NO: 451 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 10: note = 2-amino-2-ethylbutanoic acid
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSXKGXXPF

SEQ ID NO: 452 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 10: note = (S)-tert-butylglycine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSXKGXXPF

SEQ ID NO: 453 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 15: note = 4-Iodo-D-phenylalanine
  REGION 1..15: note = source = /note="Description of Artificial Sequence: Synthetic peptide"
  REGION 1..15: note = source = /note="N-term Tridecanoic acid"
XXXQRPRXSHKGXXF

SEQ ID NO: 454 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 6: note = Alpha-amino-isobutyric acid
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRXRXSHKGXXPF

SEQ ID NO: 455 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 6: note = 2-amino-2-ethylbutanoic acid
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRXRXSHKGXXPF

SEQ ID NO: 456 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = (S)-6-guanidino-2-(methylamino)hexanoic acid
  MOD_RES 8: note = Alpha-methyl-leucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 457 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Alpha-methyl-leucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 458 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Beta-leucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 459 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = N-alpha-methylleucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 460 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = (S)-5-guanidino-2-(methylamino)pentanoic acid; N-alpha-methylarginine
  MOD_RES 8: note = Alpha-methyl-leucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 461 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Hexanedioic acid"
XXXQRPRLSHKGPXPF

SEQ ID NO: 462 - protein, 16 aa, synthetic construct
  MOD_RES 1: note = Alpha-carboxy-4-aminobutyric acid
  MOD_RES 2: note = Alpha-carboxy-4-aminobutyric acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 463 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Beta-homoglutamine
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 464 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 9: note = Beta-alanine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLAHKGPXPF

SEQ ID NO: 465 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPQLSHKGPXPF

SEQ ID NO: 466 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 11: note = Norleucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHXGPXPF

SEQ ID NO: 467 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 9: note = N-alpha-(2-hydroxyethyl)-glycine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLXHKGPXPF

SEQ ID NO: 468 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 9: note = Alpha-methyl-serine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 469 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 10: note = Histidine Psi(CH2NH) -reduced amide bond
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 470 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 3-(2-naphthyl)alanine
  REGION 1..16: note = source = /note="Description of Artificial Sequence: Synthetic peptide"
  REGION 1..16: note = source = /note="N-term Tridecanoic acid"
XXXQRPRLSHKGPXPX

SEQ ID NO: 471 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-6-guanidino-2-(methylamino)hexanoic acid
  MOD_RES 14: note = Norleucine
  MOD_RES 16: note = 3-(2-naphthyl)alanine
  REGION 1..16: note = source = /note="Description of Artificial Sequence: Synthetic peptide"
  REGION 1..16: note = source = /note="N-term Tridecanoic acid"
XXXQRPRLSHKGPXPX

SEQ ID NO: 472 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Alpha-methyl-leucine
  MOD_RES 14: note = Norleucine
  MOD_RES 16: note = 3-(2-naphthyl)alanine
  REGION 1..16: note = source = /note="Description of Artificial Sequence: Synthetic peptide"
  REGION 1..16: note = source = /note="N-term Tridecanoic acid"
XXXQRPRLSHKGPXPX

SEQ ID NO: 473 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = (S)-5-guanidino-2-(methylamino)pentanoic acid; N-alpha-methylarginine
  MOD_RES 8: note = Alpha-methyl-leucine
  MOD_RES 14: note = Norleucine
  MOD_RES 16: note = 3-(2-naphthyl)alanine
  REGION 1..16: note = source = /note="Description of Artificial Sequence: Synthetic peptide"
  REGION 1..16: note = source = /note="N-term Tridecanoic acid"
XXXQRPRLSHKGPXPX

SEQ ID NO: 474 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Sebacicacid"
XXXRQRPRXSHKGXXPF

SEQ ID NO: 475 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQEPRLSHKGPXPF

SEQ ID NO: 476 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRERLSHKGPXPF

SEQ ID NO: 477 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPELSHKGPXPF

SEQ ID NO: 478 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 479 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRXSHKGXXPF

SEQ ID NO: 480 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRXSHKGXXPF

SEQ ID NO: 481 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 5: note = D-Gln
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRXSHKGXXPF

SEQ ID NO: 482 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 6: note = Alpha-methyl-proline
  MOD_RES 7: note = homo-L-Arginine
  MOD_RES 8: note = Alpha-methyl-leucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 483 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = (S)-6-guanidino-2-(methylamino)hexanoic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 484 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = (S)-6-guanidino-2-(methylamino)hexanoic acid
  MOD_RES 7: note = (S)-5-guanidino-2-(methylamino)pentanoic acid; N-alpha-methylarginine
  MOD_RES 8: note = Alpha-methyl-leucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 485 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = homo-L-Arginine
  MOD_RES 8: note = Alpha-methyl-leucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 486 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 6: note = octahydroindole-2-carboxylic acid
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRXRXSHKGXXPF

SEQ ID NO: 487 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 488 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = homo-L-Arginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 489 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = homo-L-Arginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 490 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPRXSHKGXXPF

SEQ ID NO: 491 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Butanoyl"
XXXQRPRLSHKGPXPF

SEQ ID NO: 492 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term hexanoyl"
XXXQRPRLSHKGPXPF

SEQ ID NO: 493 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Octanoic acid"
XXXQRPRLSHKGPXPF

SEQ ID NO: 494 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Decanoyl"
XXXQRPRLSHKGPXPF

SEQ ID NO: 495 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Pentadecanoic acid"
XXXQRPRLSHKGPXPF

SEQ ID NO: 496 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Heptadecanoic acid"
XXXQRPRLSHKGPXPF

SEQ ID NO: 497 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Succinicacid"
XXXQRPRLSHKGPXPF

SEQ ID NO: 498 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = Alpha-methyl-proline
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGPXXF

SEQ ID NO: 499 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXXF

SEQ ID NO: 500 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 9: note = Beta-homoserine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXXF

SEQ ID NO: 501 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 6: note = Alpha-methyl-proline
  MOD_RES 7: note = homo-L-Arginine
  MOD_RES 8: note = Beta-leucine
  MOD_RES 13: note = pipecolic acid
  MOD_RES 14: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXXQRPRLSHKGXXF

SEQ ID NO: 502 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 6: note = Alpha-methyl-proline
  MOD_RES 7: note = homo-L-Arginine
  MOD_RES 8: note = Beta-leucine
  MOD_RES 13: note = octahydroindole-2-carboxylic acid
  MOD_RES 14: note = Norleucine
  MOD_RES 15: note = Alpha-methyl-proline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 503 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 6: note = Alpha-methyl-proline
  MOD_RES 7: note = homo-L-Arginine
  MOD_RES 8: note = Beta-leucine
  MOD_RES 13: note = pipecolic acid
  MOD_RES 14: note = Norleucine
  MOD_RES 15: note = Alpha-methyl-proline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 504 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 6: note = Alpha-methyl-proline
  MOD_RES 7: note = homo-L-Arginine
  MOD_RES 8: note = Beta-leucine
  MOD_RES 13: note = Alpha-methyl-proline
  MOD_RES 14: note = Norleucine
  MOD_RES 15: note = Alpha-methyl-proline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGPXPF

SEQ ID NO: 505 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 6: note = Alpha-methyl-proline
  MOD_RES 7: note = homo-L-Arginine
  MOD_RES 8: note = Beta-leucine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXXF

SEQ ID NO: 506 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = [2-(2-Amino-ethoxy)-ethoxy]-acetic acid
  MOD_RES 5: note = homo-L-Arginine
  MOD_RES 7: note = homo-L-Arginine
  MOD_RES 9: note = (S)-5-guanidino-2-(methylamino)pentanoic acid; N-alpha-methylarginine
  MOD_RES 10: note = Cyclohexylalanine
  MOD_RES 15: note = octahydroindole-2-carboxylic acid
  MOD_RES 16: note = Norleucine
  MOD_RES 18: note = 4-chloro-L-phenylalanine
  REGION 1..18: note = source = /note="Description of Artificial Sequence: Synthetic peptide"
  REGION 1..18: note = source = /note="N-term hexanoyl"
XXXXRQRPRXSHKGXXPF

SEQ ID NO: 507 - protein, 15 aa, synthetic construct
  MOD_RES 1: note = [2-(2-Amino-ethoxy)-ethoxy]-acetic acid
  MOD_RES 2: note = [2-(2-Amino-ethoxy)-ethoxy]-acetic acid
  MOD_RES 6: note = (S)-5-guanidino-2-(methylamino)pentanoic acid; N-alpha-methylarginine
  MOD_RES 13: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXQRPRLSHKGPXPF

SEQ ID NO: 508 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Subericacid"
XXXQRPRLSHKGPXPF

SEQ ID NO: 509 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Sebacicacid"
XXXQRPRLSHKGPXPF

SEQ ID NO: 510 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Dodecanedioic acid"
XXXQRPRLSHKGPXPF

SEQ ID NO: 511 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tetradecanedioic acid"
XXXQRPRLSHKGPXPF

SEQ ID NO: 512 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Hexadecanedioic acid"
XXXQRPRLSHKGPXPF

SEQ ID NO: 513 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Octadecandioic acid"
XXXQRPRLSHKGPXPF

SEQ ID NO: 514 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = homo-L-Arginine
  MOD_RES 8: note = Alpha-methyl-leucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term hexanoyl"
XXXQRPRLSHKGPXPF

SEQ ID NO: 515 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = homo-L-Arginine
  MOD_RES 8: note = Alpha-methyl-leucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Hexanedioic acid"
XXXQRPRLSHKGPXPF

SEQ ID NO: 516 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 6: note = Beta-homoproline
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXXF

SEQ ID NO: 517 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 6: note = pipecolic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRXRXSHKGXXXF

SEQ ID NO: 518 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 9: note = Beta-homoserine
  MOD_RES 13: note = octahydroindole-2-carboxylic acid
  MOD_RES 14: note = Norleucine
  MOD_RES 15: note = Alpha-methyl-proline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 519 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 6: note = Alpha-methyl-proline
  MOD_RES 7: note = homo-L-Arginine
  MOD_RES 8: note = Beta-leucine
  MOD_RES 13: note = octahydroindole-2-carboxylic acid
  MOD_RES 14: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXXQRPRLSHKGXXF

SEQ ID NO: 520 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 6: note = (S)-5-guanidino-2-(methylamino)pentanoic acid; N-alpha-methylarginine
  MOD_RES 7: note = Cyclohexylalanine
  MOD_RES 12: note = octahydroindole-2-carboxylic acid
  MOD_RES 13: note = Norleucine
  MOD_RES 14: note = Alpha-amino-isobutyric acid
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXXQPRXSHKGXXXF

SEQ ID NO: 521 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 6: note = pipecolic acid
  MOD_RES 7: note = homo-L-Arginine
  MOD_RES 8: note = Beta-leucine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRXRLSHKGXXXF

SEQ ID NO: 522 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 6: note = Beta-homoproline
  MOD_RES 7: note = homo-L-Arginine
  MOD_RES 8: note = Beta-leucine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXXF

SEQ ID NO: 523 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 6: note = Alpha-methyl-proline
  MOD_RES 7: note = Norleucine
  MOD_RES 8: note = Beta-leucine
  MOD_RES 13: note = octahydroindole-2-carboxylic acid
  MOD_RES 14: note = Norleucine
  MOD_RES 15: note = Alpha-methyl-proline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPXLSHKGXXPF

SEQ ID NO: 524 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQEPRXSHKGXXXF

SEQ ID NO: 525 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = D-Glu
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQEPRXSHKGXXXF

SEQ ID NO: 526 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPEXSHKGXXXF

SEQ ID NO: 527 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = D-Glu
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPEXSHKGXXXF

SEQ ID NO: 528 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = Norleucine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPXXSHKGXXXF

SEQ ID NO: 529 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = Norleucine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPXXSAKGXXXF

SEQ ID NO: 530 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSAKGXXXF

SEQ ID NO: 531 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSYKGXXXF

SEQ ID NO: 532 - protein, 14 aa, synthetic construct
  MOD_RES 1: note = Alpha-carboxy-4-aminobutyric acid
  MOD_RES 2: note = D-Gln
  MOD_RES 5: note = (S)-5-guanidino-2-(methylamino)pentanoic acid; N-alpha-methylarginine
  MOD_RES 6: note = Cyclohexylalanine
  MOD_RES 11: note = octahydroindole-2-carboxylic acid
  MOD_RES 12: note = Norleucine
  MOD_RES 13: note = Alpha-amino-isobutyric acid
  MOD_RES 14: note = 4-chloro-L-phenylalanine
  REGION 1..14: note = source = /note="Description of Artificial Sequence: Synthetic peptide"
  REGION 1..14: note = source = /note="N-term Tridecanoic acid"
XQRPRXSHKGXXXF

SEQ ID NO: 533 - protein, 15 aa, synthetic construct
  MOD_RES 1: note = Alpha-carboxy-4-aminobutyric acid
  MOD_RES 2: note = Alpha-carboxy-4-aminobutyric acid
  MOD_RES 3: note = D-Gln
  MOD_RES 6: note = (S)-5-guanidino-2-(methylamino)pentanoic acid; N-alpha-methylarginine
  MOD_RES 7: note = Cyclohexylalanine
  MOD_RES 12: note = octahydroindole-2-carboxylic acid
  MOD_RES 13: note = Norleucine
  MOD_RES 14: note = Alpha-amino-isobutyric acid
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXQRPRXSHKGXXXF

SEQ ID NO: 534 - protein, 17 aa, synthetic construct
  MOD_RES 1: note = Alpha-carboxy-4-aminobutyric acid
  MOD_RES 2: note = Alpha-carboxy-4-aminobutyric acid
  MOD_RES 3: note = [2-(2-Amino-ethoxy)-ethoxy]-acetic acid
  MOD_RES 4: note = [2-(2-Amino-ethoxy)-ethoxy]-acetic acid
  MOD_RES 5: note = D-Gln
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = Alpha-amino-isobutyric acid
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXXQRPRXSHKGXXXF

SEQ ID NO: 535 - protein, 16 aa, synthetic construct
  MOD_RES 1: note = Alpha-carboxy-4-aminobutyric acid
  MOD_RES 2: note = Alpha-carboxy-4-aminobutyric acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXXF

SEQ ID NO: 536 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = Alpha-carboxy-4-aminobutyric acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXXF

SEQ ID NO: 537 - protein, 16 aa, synthetic construct
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
EXXQRPRXSHKGXXXF

SEQ ID NO: 538 - protein, 16 aa, synthetic construct
  MOD_RES 1: note = D-Asp
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
DXXQRPRXSHKGXXXF

SEQ ID NO: 539 - protein, 14 aa, synthetic construct
  MOD_RES 1: note = Alpha-carboxy-4-aminobutyric acid(N-Polyethylene glycol x11)
  MOD_RES 2: note = D-Gln
  MOD_RES 5: note = (S)-5-guanidino-2-(methylamino)pentanoic acid; N-alpha-methylarginine
  MOD_RES 6: note = Cyclohexylalanine
  MOD_RES 11: note = octahydroindole-2-carboxylic acid
  MOD_RES 12: note = Norleucine
  MOD_RES 13: note = Alpha-amino-isobutyric acid
  MOD_RES 14: note = 4-chloro-L-phenylalanine
  REGION 1..14: note = source = /note="Description of Artificial Sequence: Synthetic peptide"
  REGION 1..14: note = source = /note="N-term Tridecanoic acid"
XQRPRXSHKGXXXF

SEQ ID NO: 540 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXXF

SEQ ID NO: 541 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-methyl-proline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 542 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 543 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 12: note = (S)-tert-butylglycine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKXXXXF

SEQ ID NO: 544 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXPF

SEQ ID NO: 545 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = Alpha-methyl-proline
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGPXPF

SEQ ID NO: 546 - protein, 16 aa, synthetic construct
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
DXXQRPRXSHKGXXXF

SEQ ID NO: 547 - protein, 16 aa, synthetic construct
  MOD_RES 1: note = D-Glu
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
EXXQRPRXSHKGXXXF

SEQ ID NO: 548 - protein, 32 aa, synthetic construct
  MOD_RES 21: note = Alpha-carboxy-4-aminobutyric acid-Palmitic acid
  REGION 1..32: note = source = /note="Description of Artificial Sequence: Synthetic polypeptide"
HAEGTFTSDVSSYLEGQAAKXEFIAWLVRGRG

SEQ ID NO: 549 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 2-amino-2-ethylbutanoic acid
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXSHKGXXXF

SEQ ID NO: 550 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = Beta-homoproline
  MOD_RES 6: note = (S)-5-guanidino-2-(methylamino)pentanoic acid; N-alpha-methylarginine
  MOD_RES 7: note = Cyclohexylalanine
  MOD_RES 12: note = octahydroindole-2-carboxylic acid
  MOD_RES 13: note = Norleucine
  MOD_RES 14: note = Alpha-amino-isobutyric acid
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXXQPRXSHKGXXXF

SEQ ID NO: 551 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = Alpha-methyl-proline
  MOD_RES 14: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term Tridecanoic acid"
XXXQRPRXSHKGPXF

SEQ ID NO: 552 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = Beta-leucine
  MOD_RES 6: note = Alpha-methyl-proline
  MOD_RES 7: note = homo-L-Arginine
  MOD_RES 8: note = Alpha-methyl-leucine
  MOD_RES 13: note = octahydroindole-2-carboxylic acid
  MOD_RES 14: note = Norleucine
  MOD_RES 15: note = Alpha-methyl-proline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXLRPRLSHKGXXPF

SEQ ID NO: 553 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 6: note = Beta-homoproline
  MOD_RES 7: note = (S)-5-guanidino-2-(methylamino)pentanoic acid; N-alpha-methylarginine
  MOD_RES 8: note = Alpha-methyl-leucine
  MOD_RES 13: note = octahydroindole-2-carboxylic acid
  MOD_RES 14: note = Norleucine
  MOD_RES 15: note = Alpha-methyl-proline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 554 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 555 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 13: note = pipecolic acid
  MOD_RES 14: note = Norleucine
  MOD_RES 15: note = Alpha-methyl-proline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 556 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 6: note = Alpha-methyl-proline
  MOD_RES 7: note = homo-L-Arginine
  MOD_RES 8: note = Beta-leucine
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 557 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = (S)-tert-butylglycine
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXXRPRXSHKGXXPF

SEQ ID NO: 558 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = 2-amino-2-ethylbutanoic acid
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXXRPRXSHKGXXPF

SEQ ID NO: 559 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = homo-L-Arginine
  MOD_RES 8: note = Alpha-methyl-leucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term hexanoyl"
XXXQRPRLSHKGPXPF

SEQ ID NO: 560 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 6: note = Alpha-methyl-proline
  MOD_RES 7: note = homo-L-Arginine
  MOD_RES 8: note = Alpha-methyl-leucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term hexanoyl"
XXXQRPRLSHKGPXPF

SEQ ID NO: 561 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = (S)-6-guanidino-2-(methylamino)hexanoic acid
  MOD_RES 7: note = (S)-5-guanidino-2-(methylamino)pentanoic acid; N-alpha-methylarginine
  MOD_RES 8: note = Alpha-methyl-leucine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term hexanoyl"
XXXQRPRLSHKGPXPF

SEQ ID NO: 562 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term hexanoyl"
XXXQRPRXSHKGXXXF

SEQ ID NO: 563 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Arg
  MOD_RES 7: note = homo-L-Arginine
  MOD_RES 9: note = D-Arg
  MOD_RES 10: note = N-alpha-methylleucine
  MOD_RES 15: note = pipecolic acid
  MOD_RES 16: note = para-iodophenylalanine
  MOD_RES 18: note = (R)-3-([1,1'-biphenyl]-4-yl)-2-aminopropanoic acid
  REGION 1..18: note = source = /note="Description of Artificial Sequence: Synthetic peptide"
  REGION 1..18: note = source = /note="N-term hexanoyl"
XXXRRQRPRLSHKGXFPX

SEQ ID NO: 564 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 6: note = Norleucine
  MOD_RES 8: note = homo-L-Arginine
  MOD_RES 9: note = Cyclohexylalanine
  MOD_RES 14: note = pipecolic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQXPRXSAKGXXPF

SEQ ID NO: 565 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 8: note = homo-L-Arginine
  MOD_RES 9: note = N-alpha-methylleucine
  MOD_RES 14: note = pipecolic acid
  MOD_RES 15: note = para-iodophenylalanine
  MOD_RES 17: note = (R)-3-([1,1'-biphenyl]-4-yl)-2-aminopropanoic acid
  REGION 1..17: note = source = /note="Description of Artificial Sequence: Synthetic peptide"
  REGION 1..17: note = source = /note="N-term Tridecanoic acid"
XXXRQRPRLSHKGXFPX

SEQ ID NO: 566 - protein, 19 aa, synthetic construct
  MOD_RES 1: note = 6-aminohexanoic acid
  MOD_RES 2: note = Alpha-carboxy-4-aminobutyric acid
  MOD_RES 3: note = [2-(2-Amino-ethoxy)-ethoxy]-acetic acid
  MOD_RES 4: note = [2-(2-Amino-ethoxy)-ethoxy]-acetic acid
  MOD_RES 5: note = homo-L-Arginine
  MOD_RES 6: note = D-Arg
  MOD_RES 8: note = homo-L-Arginine
  MOD_RES 10: note = D-Arg
  MOD_RES 11: note = N-alpha-methylleucine
  MOD_RES 16: note = octahydroindole-2-carboxylic acid
  MOD_RES 17: note = para-iodophenylalanine
  MOD_RES 19: note = (R)-3-([1,1'-biphenyl]-4-yl)-2-aminopropanoic acid
  REGION 1..19: note = source = /note="Description of Artificial Sequence: Synthetic peptide"
  REGION 1..19: note = source = /note="N-term hexanoyl"
XXXXRRQRPRLSHKGXFPX

SEQ ID NO: 567 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 568 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Norleucine
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 569 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 570 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-methyl-proline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 571 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 572 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Beta-alanine
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHKGXXAF

SEQ ID NO: 573 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Beta-homo-D-phenylalanine
  REGION 1..15: note = source = /note="Description of Artificial Sequence: Synthetic peptide"
  REGION 1..15: note = source = /note="N-term Palmitic acid"
XXXQRPRXSHKGXXF

SEQ ID NO: 574 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Norleucine
  MOD_RES 15: note = Beta-homo-D-phenylalanine
  REGION 1..15: note = source = /note="Description of Artificial Sequence: Synthetic peptide"
  REGION 1..15: note = source = /note="N-term Palmitic acid"
XXXQRPRXSHKGXXF

SEQ ID NO: 575 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = Beta-homophenylalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 576 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-D-phenylalanine
  REGION 1..16: note = source = /note="Description of Artificial Sequence: Synthetic peptide"
  REGION 1..16: note = source = /note="N-term Heptadecanoic acid"
XXXQRPRXSHKGXXPF

SEQ ID NO: 577 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = Beta-homophenylalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 578 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Beta-homophenylalanine
  REGION 1..15: note = source = /note="Description of Artificial Sequence: Synthetic peptide"
  REGION 1..15: note = source = /note="N-term Palmitic acid"
XXXQRPRXSHKGXXF

SEQ ID NO: 579 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Norleucine
  MOD_RES 15: note = Beta-homophenylalanine
  REGION 1..15: note = source = /note="Description of Artificial Sequence: Synthetic peptide"
  REGION 1..15: note = source = /note="N-term Palmitic acid"
XXXQRPRXSHKGXXF

SEQ ID NO: 580 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Alpha-amino-isobutyric acid
  MOD_RES 15: note = 4-chloro-L-phenylalanine
  REGION 1..15: note = source = /note="Description of Artificial Sequence: Synthetic peptide"
  REGION 1..15: note = source = /note="N-term Palmitic acid"
XXXQRPRXSHKGXXF

SEQ ID NO: 581 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Alpha-amino-isobutyric acid
  MOD_RES 15: note = 4-chloro-L-phenylalanine
  REGION 1..15: note = source = /note="Description of Artificial Sequence: Synthetic peptide"
  REGION 1..15: note = source = /note="N-term Palmitic acid"
XXXQRPRXSHKGXXF

SEQ ID NO: 582 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = nipecotic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 583 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = piperidine-4-carboxylic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 584 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 1-aminocyclohexanecarboxylic acid
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 585 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = 1-aminocyclopentanecarboxylic acid
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 586 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = nipecotic acid
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 587 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = piperidine-4-carboxylic acid
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 588 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Norleucine
  MOD_RES 15: note = nipecotic acid
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 589 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Norleucine
  MOD_RES 15: note = piperidine-4-carboxylic acid
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 590 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Norleucine
  MOD_RES 16: note = 2-aminoindane-2-carboxylic acid
  REGION 1..16: note = source = /note="Description of Artificial Sequence: Synthetic peptide"
  REGION 1..16: note = source = /note="N-term Palmitic acid"
XXXQRPRXSHKGXXPX

SEQ ID NO: 591 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term dodecanoic acid"
XXXQRPRLSHKGPXPF

SEQ ID NO: 592 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Myristoic acid"
XXXQRPRLSHKGPXPF

SEQ ID NO: 593 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLSHKGPXPF

SEQ ID NO: 594 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Octadecanoic acid"
XXXQRPRLSHKGPXPF

SEQ ID NO: 595 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 15: note = 2-aminoindane-2-carboxylic acid
  REGION 1..15: note = source = /note="Description of Artificial Sequence: Synthetic peptide"
  REGION 1..15: note = source = /note="N-term Tridecanoic acid"
XXXQRPRXSHKGXXX

SEQ ID NO: 596 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 15: note = octahydroindole-2-carboxylic acid
  REGION 1..15: note = source = /note="Description of Artificial Sequence: Synthetic peptide"
  REGION 1..15: note = source = /note="N-term Tridecanoic acid"
XXXQRPRXSHKGXXX

SEQ ID NO: 597 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Norleucine
  MOD_RES 15: note = 2-aminoindane-2-carboxylic acid
  REGION 1..15: note = source = /note="Description of Artificial Sequence: Synthetic peptide"
  REGION 1..15: note = source = /note="N-term Palmitic acid"
XXXQRPRXSHKGXXX

SEQ ID NO: 598 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Norleucine
  MOD_RES 16: note = 1,2,3,4-tetrahydroisoquinoline
  REGION 1..16: note = source = /note="Description of Artificial Sequence: Synthetic peptide"
  REGION 1..16: note = source = /note="N-term Palmitic acid"
XXXQRPRXSHKGXXPX

SEQ ID NO: 599 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Norleucine
  MOD_RES 16: note = (R)-1,2,3,4-tetrahydroisoquinoline-3-carboxylic acid
  REGION 1..16: note = source = /note="Description of Artificial Sequence: Synthetic peptide"
  REGION 1..16: note = source = /note="N-term Palmitic acid"
XXXQRPRXSHKGXXPX

SEQ ID NO: 600 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Beta-homoproline
  MOD_RES 16: note = 4-chloro-D-phenylalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 601 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = pipecolic acid
  MOD_RES 16: note = 4-chloro-D-phenylalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 602 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = nipecotic acid
  MOD_RES 16: note = 4-chloro-D-phenylalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 603 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = piperidine-4-carboxylic acid
  MOD_RES 16: note = 4-chloro-D-phenylalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 604 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = 4-chloro-D-phenylalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 605 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 7: note = (S)-5-guanidino-2-(methylamino)pentanoic acid; N-alpha-methylarginine
  MOD_RES 8: note = Alpha-methyl-leucine
  MOD_RES 13: note = pipecolic acid
  MOD_RES 14: note = Norleucine
  MOD_RES 15: note = Alpha-methyl-proline
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRLSHKGXXPF

SEQ ID NO: 606 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = Alpha-methylphenyalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 607 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 16: note = D-alpha-methylphenyalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 608 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-amino-isobutyric acid
  MOD_RES 16: note = Alpha-methylphenyalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 609 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = pipecolic acid
  MOD_RES 16: note = Alpha-methylphenyalanine
  REGION 1..16: note = source = /note="Description of Artificial Sequence: Synthetic peptide"
  REGION 1..16: note = source = /note="N-term Palmitic acid"
XXXQRPRXSHKGXXXF

SEQ ID NO: 610 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Alpha-methyl-proline
  MOD_RES 16: note = Alpha-methylphenyalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 611 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Beta-homoproline
  MOD_RES 16: note = Alpha-methylphenyalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 612 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = octahydroindole-2-carboxylic acid
  MOD_RES 14: note = Norleucine
  MOD_RES 15: note = Beta-homoproline
  MOD_RES 16: note = D-alpha-methylphenyalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 613 - protein, 15 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = Beta-homoproline
  MOD_RES 14: note = Norleucine
  MOD_RES 15: note = 4-chloro-L-phenylalanine
  REGION 1..15: note = source = /note="Description of Artificial Sequence: Synthetic peptide"
  REGION 1..15: note = source = /note="N-term Palmitic acid"
XXXQRPRXSHKGPXF

SEQ ID NO: 614 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 615 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 9: note = Beta-leucine
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXLHKGXXPF

SEQ ID NO: 616 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 10: note = diaminopropionic acid
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSXKGXXPF

SEQ ID NO: 617 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 10: note = D-His
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 618 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 11: note = Ornithine
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHXGXXPF

SEQ ID NO: 619 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 11: note = Alpha-methyl-ornithine
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHXGXXPF

SEQ ID NO: 620 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 11: note = 3-pyridinylalanine
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHXGXXPF

SEQ ID NO: 621 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 11: note = 4-chloro-L-phenylalanine
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHFGXXPF

SEQ ID NO: 622 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 11: note = 4-fluoro-L-phenylalanine
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHFGXXPF

SEQ ID NO: 623 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 11: note = Alpha, gamma-diaminobutyric acid
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHXGXXPF

SEQ ID NO: 624 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 11: note = diaminopropionic acid
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHXGXXPF

SEQ ID NO: 625 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 11: note = (S)-2-amino-2-(2,3-dihydro-1H-inden-2-yl)acetic acid
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHXGXXPF

SEQ ID NO: 626 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 12: note = Sarcosine
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHKXXXPF

SEQ ID NO: 627 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 9: note = Alpha-methyl-serine
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLSHKGXXPF

SEQ ID NO: 628 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 9: note = Beta-leucine
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLLHKGXXPF

SEQ ID NO: 629 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 10: note = 4,4'-biphenylalanine
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLSXKGXXPF

SEQ ID NO: 630 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 10: note = diaminopropionic acid
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLSXKGXXPF

SEQ ID NO: 631 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLSHKGXXPF

SEQ ID NO: 632 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 11: note = 2-(piperidin-4-ylamino)acetic acid
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLSHXGXXPF

SEQ ID NO: 633 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 11: note = 2-(piperidin-4-ylamino)acetic acid
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHXGXXPF

SEQ ID NO: 634 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 11: note = Ornithine
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLSHXGXXPF

SEQ ID NO: 635 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 11: note = Alpha-methyl-ornithine
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLSHXGXXPF

SEQ ID NO: 636 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 11: note = 3-pyridinylalanine
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLSHXGXXPF

SEQ ID NO: 637 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 11: note = 4-fluoro-L-phenylalanine
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLSHFGXXPF

SEQ ID NO: 638 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 11: note = Alpha, gamma-diaminobutyric acid
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLSHXGXXPF

SEQ ID NO: 639 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 11: note = diaminopropionic acid
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLSHXGXXPF

SEQ ID NO: 640 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 11: note = (S)-2-amino-2-(2,3-dihydro-1H-inden-2-yl)acetic acid
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLSHXGXXPF

SEQ ID NO: 641 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Alpha-methyl-leucine
  MOD_RES 12: note = Sarcosine
  MOD_RES 13: note = octahydroindole-2-carboxylic acid
  MOD_RES 14: note = Norleucine
  MOD_RES 15: note = Beta-homoproline
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRLSHKXXXPF

SEQ ID NO: 642 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 9: note = Alpha-methyl-serine
  MOD_RES 13: note = octahydroindole-2-carboxylic acid
  MOD_RES 14: note = Norleucine
  MOD_RES 15: note = Beta-homoproline
  MOD_RES 16: note = Beta-homo-D-phenylalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 643 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 9: note = 2-(propylamino)acetic acid
  MOD_RES 13: note = pipecolic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRXXHKGXXXF

SEQ ID NO: 644 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 10: note = 2-(propylamino)acetic acid
  MOD_RES 13: note = pipecolic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPRXSXKGXXXF

SEQ ID NO: 645 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = 2-(piperidin-4-ylamino)acetic acid
  MOD_RES 8: note = Cyclohexylalanine
  MOD_RES 13: note = pipecolic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQRPXXSHKGXXXF

SEQ ID NO: 646 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = 2-(piperidin-4-ylamino)acetic acid
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Norleucine
  MOD_RES 15: note = Alpha-amino-isobutyric acid
  MOD_RES 16: note = 4-chloro-L-phenylalanine
  REGION 1..16: note = source = /note="Description of Artificial Sequence: Synthetic peptide"
  REGION 1..16: note = source = /note="N-term Palmitic acid"
XXXQXPRXSHKGXXXF

SEQ ID NO: 647 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 7: note = (S)-5-guanidino-2-(methylamino)pentanoic acid; N-alpha-methylarginine
  MOD_RES 8: note = Cyclohexylalanine
  MOD_RES 13: note = pipecolic acid
  MOD_RES 14: note = Norleucine
  MOD_RES 16: note = Beta-homophenylalanine
  REGION 1..16: note = source = /note="Description of Artificial Sequence: Synthetic peptide"
  REGION 1..16: note = source = /note="N-term Palmitic acid"
XXXQRPRXSHKGXXPF

SEQ ID NO: 648 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = homo-L-Arginine
  MOD_RES 7: note = D-Arg
  MOD_RES 8: note = Cyclohexylalanine
  REGION 9..12: note = misc_feature - /note="Cyclic"
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXEHKKXXPF

SEQ ID NO: 649 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  MOD_RES 7: note = D-Arg
  MOD_RES 8: note = Cyclohexylalanine
  REGION 9..12: note = misc_feature - /note="Cyclic"
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXEHKKXXPF

SEQ ID NO: 650 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  MOD_RES 7: note = D-Arg
  MOD_RES 8: note = Cyclohexylalanine
  REGION 9..12: note = misc_feature - /note="Cyclic"
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPRXEHKKXXPF

SEQ ID NO: 651 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Gln
  MOD_RES 5: note = homo-L-Arginine
  REGION 7..10: note = misc_feature - /note="Cyclic"
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPEXSKKGXXPF

SEQ ID NO: 652 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 5: note = D-Arg
  REGION 7..10: note = misc_feature - /note="Cyclic"
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQRPEXSKKGXXPF

SEQ ID NO: 653 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  MOD_RES 6: note = homo-L-Arginine
  REGION 8..11: note = misc_feature - /note="Cyclic"
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQRPEXSKKGXXPF

SEQ ID NO: 654 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  REGION 4..7: note = misc_feature - /note="Cyclic"
  MOD_RES 5: note = homo-L-Arginine
  MOD_RES 9: note = D-Arg
  MOD_RES 10: note = Cyclohexylalanine
  MOD_RES 15: note = octahydroindole-2-carboxylic acid
  MOD_RES 16: note = Norleucine
  MOD_RES 18: note = 4-chloro-L-phenylalanine
  REGION 1..18: note = source = /note="Description of Artificial Sequence: Synthetic peptide"
  REGION 1..18: note = source = /note="N-term Tridecanoic acid"
XXXERQKPRXSHKGXXPF

SEQ ID NO: 655 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  REGION 5..9: note = misc_feature - /note="Cyclic"
  MOD_RES 7: note = D-Arg
  MOD_RES 8: note = Cyclohexylalanine
  MOD_RES 13: note = octahydroindole-2-carboxylic acid
  MOD_RES 14: note = Norleucine
  MOD_RES 16: note = 4-chloro-L-phenylalanine
  REGION 1..16: note = source = /note="Description of Artificial Sequence: Synthetic peptide"
  REGION 1..16: note = source = /note="N-term Tridecanoic acid"
XXXQEPRXKHKGXXPF

SEQ ID NO: 656 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  REGION 6..10: note = misc_feature - /note="Cyclic"
  MOD_RES 8: note = D-Arg
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXRQEPRXKHKGXXPF

SEQ ID NO: 657 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  REGION 4..8: note = misc_feature - /note="Cyclic"
  MOD_RES 6: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXEQRPKXSHKGXXPF

SEQ ID NO: 658 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  REGION 4..8: note = misc_feature - /note="Cyclic"
  MOD_RES 5: note = D-Gln
  MOD_RES 6: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXEQRPKXSHKGXXPF

SEQ ID NO: 659 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  REGION 4..8: note = misc_feature - /note="Cyclic"
  MOD_RES 6: note = D-Arg
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
  REGION 1..17: note = source = /note="N-term Tridecanoic acid"
XXXEQRPKXSHKGXXPF

SEQ ID NO: 660 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  REGION 4..8: note = misc_feature - /note="Cyclic"
  MOD_RES 5: note = homo-L-Arginine
  MOD_RES 7: note = homo-L-Arginine
  MOD_RES 9: note = D-Arg
  MOD_RES 10: note = Cyclohexylalanine
  MOD_RES 15: note = octahydroindole-2-carboxylic acid
  MOD_RES 16: note = Norleucine
  MOD_RES 18: note = 4-chloro-L-phenylalanine
  REGION 1..18: note = source = /note="Description of Artificial Sequence: Synthetic peptide"
  REGION 1..18: note = source = /note="N-term Tridecanoic acid"
XXXERQRKRXSHKGXXPF

SEQ ID NO: 661 - protein, 15 aa, synthetic construct
  MOD_RES 1: note = D-Arg
  MOD_RES 2: note = homo-L-Arginine
  MOD_RES 4: note = homo-L-Arginine
  REGION 6..9: note = misc_feature - /note="Cyclic"
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPELSKKGXFPX

SEQ ID NO: 662 - protein, 15 aa, synthetic construct
  MOD_RES 1: note = homo-L-Arginine
  MOD_RES 2: note = homo-L-Arginine
  MOD_RES 3: note = D-Gln
  MOD_RES 4: note = homo-L-Arginine
  REGION 6..9: note = misc_feature - /note="Cyclic"
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPELSKKGXFPX

SEQ ID NO: 663 - protein, 15 aa, synthetic construct
  MOD_RES 1: note = homo-L-Arginine
  MOD_RES 2: note = homo-L-Arginine
  MOD_RES 4: note = D-Arg
  REGION 6..9: note = misc_feature - /note="Cyclic"
  MOD_RES 7: note = N-alpha-methylleucine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPELSKKGXFPX

SEQ ID NO: 664 - protein, 15 aa, synthetic construct
  MOD_RES 1: note = D-Arg
  MOD_RES 2: note = homo-L-Arginine
  MOD_RES 4: note = homo-L-Arginine
  REGION 6..9: note = misc_feature - /note="Cyclic"
  MOD_RES 7: note = Cyclohexylalanine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPEXSKKGXFPX

SEQ ID NO: 665 - protein, 15 aa, synthetic construct
  MOD_RES 1: note = homo-L-Arginine
  MOD_RES 2: note = D-Arg
  MOD_RES 4: note = homo-L-Arginine
  REGION 6..9: note = misc_feature - /note="Cyclic"
  MOD_RES 7: note = Cyclohexylalanine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPEXSKKGXFPX

SEQ ID NO: 666 - protein, 15 aa, synthetic construct
  MOD_RES 1: note = homo-L-Arginine
  MOD_RES 2: note = homo-L-Arginine
  MOD_RES 3: note = D-Gln
  MOD_RES 4: note = homo-L-Arginine
  REGION 6..9: note = misc_feature - /note="Cyclic"
  MOD_RES 7: note = Cyclohexylalanine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPEXSKKGXFPX

SEQ ID NO: 667 - protein, 15 aa, synthetic construct
  MOD_RES 1: note = homo-L-Arginine
  MOD_RES 2: note = homo-L-Arginine
  MOD_RES 4: note = D-Arg
  REGION 6..9: note = misc_feature - /note="Cyclic"
  MOD_RES 7: note = Cyclohexylalanine
  MOD_RES 12: note = octahydroindole-2-carboxylic acid
  MOD_RES 13: note = para-iodophenylalanine
  MOD_RES 15: note = (R)-3-([1,1'-biphenyl]-4-yl)-2-aminopropanoic acid
  REGION 1..15: note = source = /note="Description of Artificial Sequence: Synthetic peptide"
  REGION 1..15: note = source = /note="N-term Acetic acid"
RRQRPEXSKKGXFPX

SEQ ID NO: 668 - protein, 16 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 16: note = 3-(1-naphthyl)alanine
  REGION 1..16: note = source = /note="Description of Artificial Sequence: Synthetic peptide"
XFRRQRPRXSHKGXXX

SEQ ID NO: 669 - protein, 17 aa, synthetic construct
  MOD_RES 1: note = Ornithine
  MOD_RES 3: note = (S)-5-guanidino-2-(methylamino)pentanoic acid; N-alpha-methylarginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 670 - protein, 17 aa, synthetic construct
  MOD_RES 1: note = Ornithine
  MOD_RES 3: note = homo-L-Arginine
  MOD_RES 4: note = (S)-5-guanidino-2-(methylamino)pentanoic acid; N-alpha-methylarginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 671 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = (S)-5-guanidino-2-(methylamino)pentanoic acid; N-alpha-methylarginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 672 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = (S)-5-guanidino-2-(methylamino)pentanoic acid; N-alpha-methylarginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 673 - protein, 17 aa, synthetic construct
  MOD_RES 1: note = Ornithine
  MOD_RES 3: note = homo-L-Arginine
  MOD_RES 4: note = (S)-5-guanidino-2-(methylamino)pentanoic acid; N-alpha-methylarginine
  MOD_RES 6: note = (S)-5-guanidino-2-(methylamino)pentanoic acid; N-alpha-methylarginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 674 - protein, 14 aa, synthetic construct
  MOD_RES 1: note = homo-L-Arginine
  MOD_RES 3: note = homo-L-Arginine
  MOD_RES 5: note = (S)-5-guanidino-2-(methylamino)pentanoic acid; N-alpha-methylarginine
  MOD_RES 6: note = Cyclohexylalanine
  MOD_RES 11: note = octahydroindole-2-carboxylic acid
  MOD_RES 12: note = Norleucine
  MOD_RES 14: note = 4-chloro-L-phenylalanine
  REGION 1..14: note = source = /note="Description of Artificial Sequence: Synthetic peptide"
RQRPRXSHKGXXPF

SEQ ID NO: 675 - protein, 13 aa, synthetic construct
  MOD_RES 2: note = homo-L-Arginine
  MOD_RES 4: note = (S)-5-guanidino-2-(methylamino)pentanoic acid; N-alpha-methylarginine
  MOD_RES 5: note = Cyclohexylalanine
  MOD_RES 10: note = octahydroindole-2-carboxylic acid
  MOD_RES 11: note = Norleucine
  MOD_RES 13: note = 4-chloro-L-phenylalanine
  REGION 1..13: note = source = /note="Description of Artificial Sequence: Synthetic peptide"
QRPRXSHKGXXPF

SEQ ID NO: 676 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 7: note = Sarcosine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRXRXSHKGXXPF

SEQ ID NO: 677 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 7: note = Alpha-amino-isobutyric acid
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRXRXSHKGXXPF

SEQ ID NO: 678 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 10: note = Sarcosine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXXHKGXXPF

SEQ ID NO: 679 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 11: note = (S)-3-methyl-2-(methylamino)butanoic acid; N-alpha-methylvaline
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSVKGXXPF

SEQ ID NO: 680 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 13: note = Sarcosine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKXXXPF

SEQ ID NO: 681 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 13: note = Alpha-amino-isobutyric acid
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKXXXPF

SEQ ID NO: 682 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = Alpha-amino-isobutyric acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 683 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = Sarcosine
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 684 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 16: note = Sarcosine
  MOD_RES 17: note = 4-chloro-L-phenylalanine
  REGION 1..17: note = source = /note="Description of Artificial Sequence: Synthetic peptide"
XFRRQRPRXSHKGXXXF

SEQ ID NO: 685 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 16: note = Alpha-amino-isobutyric acid
  MOD_RES 17: note = 4-chloro-L-phenylalanine
  REGION 1..17: note = source = /note="Description of Artificial Sequence: Synthetic peptide"
XFRRQRPRXSHKGXXXF

SEQ ID NO: 686 - protein, 17 aa, synthetic construct
  MOD_RES 1: note = Ornithine
  MOD_RES 2: note = Beta-homophenylalanine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 687 - protein, 17 aa, synthetic construct
  MOD_RES 1: note = Ornithine
  MOD_RES 2: note = Beta-phenylalanine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 688 - protein, 17 aa, synthetic construct
  MOD_RES 1: note = Ornithine
  MOD_RES 3: note = Beta-homoarginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 689 - protein, 17 aa, synthetic construct
  MOD_RES 1: note = Ornithine
  MOD_RES 3: note = homo-L-Arginine
  MOD_RES 4: note = Beta-homoarginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 690 - protein, 17 aa, synthetic construct
  MOD_RES 1: note = Ornithine
  MOD_RES 3: note = homo-L-Arginine
  MOD_RES 4: note = homo-L-Arginine
  MOD_RES 5: note = Beta-homoglutamine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 691 - protein, 17 aa, synthetic construct
  MOD_RES 1: note = Ornithine
  MOD_RES 3: note = homo-L-Arginine
  MOD_RES 4: note = homo-L-Arginine
  MOD_RES 5: note = Beta-homoasparagine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRNRPRXSHKGXXPF

SEQ ID NO: 692 - protein, 17 aa, synthetic construct
  MOD_RES 1: note = Ornithine
  MOD_RES 3: note = homo-L-Arginine
  MOD_RES 4: note = homo-L-Arginine
  MOD_RES 5: note = Beta-homoleucine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRLRPRXSHKGXXPF

SEQ ID NO: 693 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = Beta-homoarginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 694 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 7: note = Beta-homoproline
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 695 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 7: note = pipecolic acid
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRXRXSHKGXXPF

SEQ ID NO: 696 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = Beta-homoarginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 697 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Beta-homoleucine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRLSHKGXXPF

SEQ ID NO: 698 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 10: note = Beta-homoserine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 699 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 10: note = Beta-alanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXAHKGXXPF

SEQ ID NO: 700 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 11: note = Beta-alanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSAKGXXPF

SEQ ID NO: 701 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 12: note = Beta-homolysine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 702 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 12: note = Beta-lysine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 703 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 12: note = Beta-alanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHAGXXPF

SEQ ID NO: 704 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 13: note = Beta-alanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKAXXPF

SEQ ID NO: 705 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = Beta-alanine
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGAXPF

SEQ ID NO: 706 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = Beta-homoproline
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGPXPF

SEQ ID NO: 707 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = pipecolic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 708 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Beta-alanine
  MOD_RES 17: note = 4-chloro-L-phenylalanine
  REGION 1..17: note = source = /note="Description of Artificial Sequence: Synthetic peptide"
XFRRQRPRXSHKGXAPF

SEQ ID NO: 709 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 16: note = Beta-homoproline
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 710 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 16: note = Beta-alanine
  MOD_RES 17: note = 4-chloro-L-phenylalanine
  REGION 1..17: note = source = /note="Description of Artificial Sequence: Synthetic peptide"
XFRRQRPRXSHKGXXAF

SEQ ID NO: 711 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 16: note = pipecolic acid
  MOD_RES 17: note = 4-chloro-L-phenylalanine
  REGION 1..17: note = source = /note="Description of Artificial Sequence: Synthetic peptide"
XFRRQRPRXSHKGXXXF

SEQ ID NO: 712 - protein, 16 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 16: note = 3-(1-naphthyl)-D-alanine
  REGION 1..16: note = source = /note="Description of Artificial Sequence: Synthetic peptide"
XFRRQRPRXSHKGXXX

SEQ ID NO: 713 - protein, 16 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 16: note = 3-(2-naphthyl)-D-alanine
  REGION 1..16: note = source = /note="Description of Artificial Sequence: Synthetic peptide"
XFRRQRPRXSHKGXXX

SEQ ID NO: 714 - protein, 17 aa, synthetic construct
  MOD_RES 1: note = Ornithine
  MOD_RES 3: note = homo-L-Arginine
  MOD_RES 4: note = homo-L-Arginine
  MOD_RES 6: note = homo-L-Arginine
  MOD_RES 8: note = homo-L-Arginine
  MOD_RES 9: note = Cyclohexylalanine
  MOD_RES 14: note = octahydroindole-2-carboxylic acid
  MOD_RES 15: note = Norleucine
  MOD_RES 17: note = 4-chloro-L-phenylalanine
  REGION 1..17: note = source = /note="Description of Artificial Sequence: Synthetic peptide"
XFRRQRPRXSHKGXXPF

SEQ ID NO: 715 - protein, 5 aa, synthetic construct
  MOD_RES 1: note = homo-L-Arginine
  MOD_RES 2: note = homo-L-Arginine
  MOD_RES 4: note = homo-L-Arginine
  REGION 1..5: note = source = /note="Description of Artificial Sequence: Synthetic peptide"
RRQRP

SEQ ID NO: 716 - protein, 228 aa, Homo sapiens
MDKTHTCPPCPAPELLGGPSVFLFPPKPKDTLMISRTPEVTCVVVDVSHEDPCVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 717 - protein, 15 aa, synthetic construct
  VARIANT 1: note = /replace="Glu" or "homo-L-Arginine" or " "
  VARIANT 2: note = /replace="D-Arg" or "Glu" or "homo-L-Arginine" or " "
  VARIANT 3: note = /replace="D-Gln" or "beta-leucine"
  VARIANT 4: note = /replace="homo-L-Arginine" or "(S)-5-guanidino-2-(methylamino)pentanoic acid; N-alpha-methylarginine" or "Glu" or "D-Arg"
  VARIANT 5: note = /replace="alpha-methyl-proline"
  VARIANT 6: note = /replace="Glu" or "D-Arg" or "homo-L-Arginine" or "(S)-5-guanidino-2-(methylamino)pentanoic acid; N-alpha-methylarginine"
  VARIANT 7: note = /replace="alpha-methyl-leucine" or "beta-leucine" or "N-alpha-methylleucine" or "Cyclohexylalanine"
  VARIANT 8: note = /replace="beta-homoserine" or "N-alpha-(2-hydroxyethyl)-glycine"
  VARIANT 9: note = /replace="Tyr"
  VARIANT 10: note = /replace="2-((4-aminobutyl)amino)acetic acid"
  VARIANT 12: note = /replace="octahydroindole-2-carboxylic acid" or "alpha-methyl-proline" or "pipecolic acid"
  MOD_RES 13: note = para-iodophenylalanine
  VARIANT 13: note = /replace="norleucine" or "Norleucine Psi(CH2NH)-reduced amide bond"
  VARIANT 14: note = /replace="beta-homoproline" or "alpha-methyl-proline" or "alpha-amino-isobutyric acid"
  VARIANT 15: note = /replace="beta-homo-D-phenylalanine" or "4-chloro-L-phenylalanine" or "4-chloro-D-phenylalanine" or "(R)-3-([1,1'-biphenyl]-4-yl)-2-aminopropanoic acid"
  REGION 1..15: note = misc_feature - /note="Variant residues given in the sequence have no preference with respect to those in the annotations for variant positions"
  REGION 1..15: note = source = /note="Description of Artificial Sequence: Synthetic peptide"
RRQRPRLSHKGPFPF

SEQ ID NO: 718 - protein, 17 aa, synthetic construct
  MOD_RES 1: note = Beta-homolysine
  VARIANT 1: note = /replace="Ornithine"
  VARIANT 2: note = /replace="beta-homophenylalanine" or "beta-phenylalanine"
  MOD_RES 3: note = homo-L-Arginine
  VARIANT 3: note = /replace="(S)-5-guanidino-2-(methylamino)pentanoic acid; N-alpha-methylarginine" or "beta-homoarginine"
  MOD_RES 4: note = homo-L-Arginine
  VARIANT 4: note = /replace="(S)-5-guanidino-2-(methylamino)pentanoic acid; N-alpha-methylarginine" or "beta-homoarginine"
  VARIANT 5: note = /replace="beta-homoglutamine" or "beta-homoasparagine" or "beta-homoleucine"
  MOD_RES 6: note = homo-L-Arginine
  VARIANT 6: note = /replace="(S)-5-guanidino-2-(methylamino)pentanoic acid; N-alpha-methylarginine" or "beta-homoarginine"
  VARIANT 7: note = /replace="Sarcosine" or "alpha-amino-isobutyric acid" or "beta-homoproline" or "pipecolic acid"
  MOD_RES 8: note = homo-L-Arginine
  VARIANT 8: note = /replace="(S)-5-guanidino-2-(methylamino)pentanoic acid; N-alpha-methylarginine" or "beta-homoarginine"
  MOD_RES 9: note = Beta-homoleucine
  VARIANT 9: note = /replace="Cyclohexylalanine"
  VARIANT 10: note = /replace="beta-homoserine" or "Sarcosine" or "beta-alanine"
  VARIANT 11: note = /replace="(S)-3-methyl-2-(methylamino)butanoic acid; N-alpha-methylvaline" or "beta-alanine"
  VARIANT 12: note = /replace="(S)-6-amino-2-(methylamino)hexanoic acid; Nalpha-methyllysine" or "beta-homolysine" or "beta-lysine" or "beta-alanine"
  VARIANT 13: note = /replace="Sarcosine" or "alpha-amino-isobutyric acid" or "beta-alanine"
  MOD_RES 14: note = Beta-alanine
  VARIANT 14: note = /replace="octahydroindole-2-carboxylic acid" or "alpha-amino-isobutyric acid" or "Sarcosine" or "beta-homoproline" or "pipecolic acid"
  MOD_RES 15: note = Beta-alanine
  VARIANT 15: note = /replace="norleucine"
  VARIANT 16: note = /replace="Sarcosine" or "alpha-amino-isobutyric acid" or "beta-homoproline" or "beta-alanine" or "pipecolic acid" or "3-(1-naphthyl)-D-alanine" or "3-(2-naphthyl)-D-alanine"
  MOD_RES 17: note = Beta-phenylalanine
  VARIANT 17: note = /replace="4-chloro-L-phenylalanine" or "beta-homophenylalanine"
  REGION 1..17: note = misc_feature - /note="Variant residues given in the sequence have no preference with respect to those in the annotations for variant positions"
  REGION 1..17: note = source = /note="Description of Artificial Sequence: Synthetic peptide"
  REGION 1..17: note = source = /note="N-term Acetic acid"
KFRRQRPRLSHKGAAPF

SEQ ID NO: 719 - protein, 15 aa, synthetic construct
  MOD_RES 1: note = D-Arg
  VARIANT 1: note = /replace="homo-L-Arginine" or " "
  VARIANT 2: note = /replace="D-Arg" or "homo-L-Arginine"
  VARIANT 3: note = /replace="D-Gln"
  VARIANT 4: note = /replace="homo-L-Arginine" or "D-Arg"
  VARIANT 5: note = /replace="octahydroindole-2-carboxylic acid"
  MOD_RES 6: note = D-Arg
  VARIANT 6: note = /replace="homo-L-Arginine" or "(S)-5-guanidino-2-(methylamino)pentanoic acid; N-alpha-methylarginine"
  MOD_RES 7: note = N-alpha-methylleucine
  VARIANT 7: note = /replace="Cyclohexylalanine"
  VARIANT 10: note = /replace="2-((4-aminobutyl)amino)acetic acid"
  MOD_RES 12: note = octahydroindole-2-carboxylic acid
  MOD_RES 13: note = para-iodophenylalanine
  VARIANT 13: note = /replace="norleucine"
  VARIANT 14: note = /replace="3-(1-naphthyl)-D-alanine" or "pipecolic acid"
  VARIANT 15: note = A D-amino acid, a beta-amino acid, a non-canonical amino acid or the D- or beta- form of the non- canonical amino acid
  REGION 1..15: note = misc_feature - /note="Variant residues given in the sequence have no preference with respect to those in the annotations for variant positions"
  REGION 1..15: note = source = /note="Description of Artificial Sequence: Synthetic peptide"
  VARIANT 1: note = source = /note="May be N-term Acetic acid"
RRQRPRLSHKGXFPX

SEQ ID NO: 720 - protein, 17 aa, synthetic construct
  MOD_RES 1: note = Ornithine
  VARIANT 1: note = /replace="D-Ornithine"
  VARIANT 2: note = /replace="D-Phe"
  MOD_RES 3: note = homo-L-Arginine
  MOD_RES 4: note = homo-L-Arginine
  VARIANT 5: note = /replace="beta-leucine"
  MOD_RES 6: note = homo-L-Arginine
  VARIANT 6: note = /replace="homoArgininePsi(CH2NH) -reduced amide bond"
  VARIANT 7: note = /replace="alpha-methyl-proline"
  MOD_RES 8: note = homo-L-Arginine
  VARIANT 8: note = /replace="homoArgininePsi(CH2NH) -reduced amide bond"
  MOD_RES 9: note = Beta-leucine
  VARIANT 9: note = /replace="alpha-methyl-leucine" or "Cyclohexylalanine Psi(CH2NH) -reduced amide bond" or "Cyclohexylalanine"
  VARIANT 10: note = /replace="N-alpha-(2-hydroxyethyl)-glycine" or "alpha-methyl-serine" or "Serine Psi(CH2NH) -reduced amide bond" or "D-Serine Psi(CH2NH)-reduced amide bond"
  VARIANT 11: note = /replace="Histidine Psi(CH2NH) -reduced amide bond"
  VARIANT 12: note = /replace="2-((4-aminobutyl)amino)acetic acid" or "Lysine Psi(CH2NH)-reduced amide bond" or "alpha-methyl-ornithine"
  MOD_RES 14: note = octahydroindole-2-carboxylic acid
  MOD_RES 15: note = Norleucine
  VARIANT 16: note = /replace="alpha-methyl-proline"
  MOD_RES 17: note = 4-chloro-L-phenylalanine
  REGION 1..17: note = misc_feature - /note="Variant residues given in the sequence have no preference with respect to those in the annotations for variant positions"
  REGION 1..17: note = source = /note="Description of Artificial Sequence: Synthetic peptide"
  REGION 1..17: note = source = /note="N-term Acetic acid"
XFRRQRPRLSHKGXXPF

SEQ ID NO: 721 - skipped

SEQ ID NO: 722 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  VARIANT 4: note = /replace=" "
  VARIANT 5: note = /replace="D-Gln"
  MOD_RES 6: note = D-Arg
  VARIANT 6: note = /replace="homo-L-Arginine"
  MOD_RES 8: note = Cyclohexylalanine
  MOD_RES 13: note = octahydroindole-2-carboxylic acid
  MOD_RES 14: note = Norleucine
  VARIANT 15: note = /replace="pipecolic acid"
  MOD_RES 16: note = 4-chloro-L-phenylalanine
  VARIANT 16: note = /replace="4-chloro-D-phenylalanine"
  REGION 1..16: note = misc_feature - /note="Variant residues given in the sequence have no preference with respect to those in the annotations for variant positions"
  REGION 1..16: note = source = /note="Description of Artificial Sequence: Synthetic peptide"
  REGION 1..16: note = source = /note="N-term Heptadecanoic acid"
XXXRQRPXSHKGXXPF

SEQ ID NO: 723 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  VARIANT 4: note = /replace=" "
  VARIANT 5: note = /replace="D-Gln"
  MOD_RES 6: note = D-Arg
  VARIANT 6: note = /replace="homo-L-Arginine"
  MOD_RES 8: note = D-Arg
  VARIANT 8: note = /replace="(S)-5-guanidino-2-(methylamino)pentanoic acid; N-alpha-methylarginine"
  MOD_RES 9: note = N-alpha-methylleucine
  VARIANT 9: note = /replace="Cyclohexylalanine"
  MOD_RES 14: note = octahydroindole-2-carboxylic acid
  MOD_RES 15: note = Norleucine
  VARIANT 16: note = /replace="pipecolic acid"
  MOD_RES 17: note = 4-chloro-L-phenylalanine
  VARIANT 17: note = /replace="D-Phe" or "4-chloro-D-phenylalanine" or "1,2,3,4-tetrahydroisoquinoline"
  REGION 1..17: note = misc_feature - /note="Variant residues given in the sequence have no preference with respect to those in the annotations for variant positions"
  REGION 1..17: note = source = /note="Description of Artificial Sequence: Synthetic peptide"
  REGION 1..17: note = source = /note="N-term Heptadecanoic acid"
XXXRQRPRLSHKGXXPF

SEQ ID NO: 724 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  VARIANT 4: note = /replace="D-Arg" or " "
  VARIANT 5: note = /replace="D-Gln" or "beta-leucine" or "(S)-5-amino-2-(methylamino)-5-oxopentanoic acid"
  MOD_RES 6: note = D-Arg
  VARIANT 6: note = /replace="homo-L-Arginine"
  VARIANT 7: note = /replace="pipecolic acid" or "octahydroindole-2-carboxylic acid" or "Sarcosine"
  MOD_RES 8: note = (S)-5-guanidino-2-(methylamino)pentanoic acid; N-alpha-methylarginine
  VARIANT 8: note = /replace="D-Arg" or "homo-L-Arginine"
  MOD_RES 9: note = N-alpha-methylleucine
  VARIANT 9: note = /replace="Cyclohexylalanine" or "beta-leucine" or "(S)-3-cyclohexyl-2-(methylamino)propanoic acid"
  VARIANT 10: note = /replace="beta-homoserine" or "beta-alanine" or "N-alpha-(2-hydroxyethyl)-glycine" or "alpha-methyl-serine"
  VARIANT 11: note = /replace="Ala" or "Tyr" or "(S)-tert-butylglycine" or "2-amino-2-ethylbutanoic acid" or "Leu" or "Val"
  MOD_RES 14: note = octahydroindole-2-carboxylic acid
  MOD_RES 15: note = para-iodophenylalanine
  VARIANT 15: note = /replace="norleucine"
  VARIANT 16: note = /replace="D-amino acid" or "beta-amino acid" or "non-canonical amino acid" or "the D- or beta- form of the non-canonical amino acid"
  MOD_RES 17: note = 4-chloro-L-phenylalanine
  VARIANT 17: note = /replace="4-chloro-D-phenylalanine" or "(R)-3-([1,1'-biphenyl]-4-yl)-2-aminopropanoic acid" or " "
  REGION 1..17: note = misc_feature - /note="Variant residues given in the sequence have no preference with respect to those in the annotations for variant positions"
  REGION 1..17: note = source = /note="Description of Artificial Sequence: Synthetic peptide"
  REGION 1..17: note = source = /note="N-term Tridecanoic acid"
XXXRQRPRLSHKGXFPF

SEQ ID NO: 725 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  VARIANT 4: note = /replace=" "
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  VARIANT 16: note = /replace="D-amino acid" or "non-canonical amino acid"
  VARIANT 17: note = A D-amino acid, a non-canonical amino acid or not present
  REGION 1..17: note = misc_feature - /note="Variant residues given in the sequence have no preference with respect to those in the annotations for variant positions"
  REGION 1..17: note = source = /note="Description of Artificial Sequence: Synthetic peptide"
  REGION 1..17: note = source = /note="N-term Tridecanoic acid"
XXXRQRPRXSHKGXXPX

SEQ ID NO: 726 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = homo-L-Arginine
  MOD_RES 5: note = D-Gln
  MOD_RES 6: note = homo-L-Arginine
  MOD_RES 8: note = (S)-5-guanidino-2-(methylamino)pentanoic acid; N-alpha-methylarginine
  MOD_RES 9: note = Cyclohexylalanine
  MOD_RES 14: note = octahydroindole-2-carboxylic acid
  MOD_RES 15: note = Norleucine
  VARIANT 16: note = A D-amino acid, a beta-amino acid, a non-canonical amino acid or the D- or beta - form of the non-canonical amino acid
  REGION 1..16: note = source = /note="Description of Artificial Sequence: Synthetic peptide"
  REGION 1..16: note = source = /note="N-term Tridecanoic acid"
XXXRQRPRXSHKGXXX

SEQ ID NO: 727 - protein, 16 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  VARIANT 5: note = /replace="D-Arg" or "homo-L-Arginine"
  MOD_RES 7: note = D-Arg
  VARIANT 7: note = /replace="homo-L-Arginine" or "(S)-5-guanidino-2-(methylamino)pentanoic acid; N-alpha-methylarginine"
  MOD_RES 8: note = N-alpha-methylleucine
  VARIANT 8: note = /replace="Cyclohexylalanine"
  MOD_RES 13: note = octahydroindole-2-carboxylic acid
  MOD_RES 14: note = para-iodophenylalanine
  VARIANT 14: note = /replace="norleucine"
  VARIANT 15: note = /replace="3-(1-naphthyl)-D-alanine"
  MOD_RES 16: note = 4-chloro-L-phenylalanine
  VARIANT 16: note /replace="(R)-3-([1,1'-biphenyl]-4-yl)-2-aminopropanoic acid" or "4-chloro-D-phenylalanine" or " "
  REGION 1..16: note = misc_feature - /note="Variant residues given in the sequence have no preference with respect to those in the annotations for variant positions"
  REGION 1..16: note = source = /note="Description of Artificial Sequence: Synthetic peptide"
  REGION 1..16: note = source = /note="N-term Tridecanoic acid"
XXXQRPRLSHKGXFPF

SEQ ID NO: 728 - protein, 17 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  MOD_RES 4: note = D-Arg
  VARIANT 4: note = /replace="homo-L-Arginine"
  VARIANT 5: note = /replace="D-Gln"
  MOD_RES 6: note = D-Arg
  VARIANT 6: note = /replace="homo-L-Arginine"
  MOD_RES 8: note = D-Arg
  VARIANT 8: note = /replace="(S)-5-guanidino-2-(methylamino)pentanoic acid; N-alpha-methylarginine"
  MOD_RES 9: note = N-alpha-methylleucine
  VARIANT 9: note = /replace="beta-leucine" or "Cyclohexylalanine"
  VARIANT 10: note = /replace="beta-alanine"
  VARIANT 11: note = /replace="Ala" or "(S)-tert-butylglycine"
  MOD_RES 14: note = octahydroindole-2-carboxylic acid
  MOD_RES 15: note = para-iodophenylalanine
  VARIANT 15: note = /replace="norleucine"
  VARIANT 16: note = /replace="D-amino acid" or "beta-amino acid" or "non-canonical amino acid" or "the D- or beta- form of the non-canonical amino acid"
  MOD_RES 17: note = 4-chloro-D-phenylalanine
  VARIANT 17: note = /replace="octahydroindole-2-carboxylic acid" or "4-chloro-L-phenylalanine" or "3-(1-naphthyl)-D-alanine" or "(R)-3-([1,1'-biphenyl]-4-yl)-2-aminopropanoic acid" or " "
  REGION 1..17: note = misc_feature - /note="Variant residues given in the sequence have no preference with respect to those in the annotations for variant positions"
  REGION 1..17: note = source = /note="Description of Artificial Sequence: Synthetic peptide"
  REGION 1..17: note = source = /note="N-term Tridecanoic acid"
XXXRQRPRLSHKGXFPF

SEQ ID NO: 729 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 730 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 731 - protein, 330 aa, Homo sapiens [sequence omitted]

SEQ ID NO: 732 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 733 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 734-735 - skipped (2 entries)

SEQ ID NO: 736 - protein, 4 aa, synthetic construct
  REGION 1..4: note = source = /note="Description of Artificial Sequence: Synthetic peptide"
GGGG

SEQ ID NO: 737 - protein, 5 aa, synthetic construct
  REGION 1..5: note = source = /note="Description of Artificial Sequence: Synthetic peptide"
GGGGG

SEQ ID NO: 738 - protein, 7 aa, synthetic construct
  REGION 1..7: note = source = /note="Description of Artificial Sequence: Synthetic peptide"
GGGGGGG

SEQ ID NO: 739 - protein, 15 aa, synthetic construct
  REGION 1..15: note = source = /note="Description of Artificial Sequence: Synthetic peptide"
GGGGSGGGGSGGGGS

SEQ ID NO: 740 - protein, 6 aa, synthetic construct
  REGION 1..6: note = source = /note="Description of Artificial Sequence: Synthetic peptide"
GGGGGK

SEQ ID NO: 741 - protein, 7 aa, synthetic construct
  REGION 1..7: note = source = /note="Description of Artificial Sequence: Synthetic peptide"
GGGGGKR

SEQ ID NO: 742 - protein, 8 aa, synthetic construct
  REGION 1..8: note = source = /note="Description of Artificial Sequence: Synthetic peptide"
GGGKGGGG

SEQ ID NO: 743 - protein, 8 aa, synthetic construct
  REGION 1..8: note = source = /note="Description of Artificial Sequence: Synthetic peptide"
GGGNGSGG

SEQ ID NO: 744 - protein, 8 aa, synthetic construct
  REGION 1..8: note = source = /note="Description of Artificial Sequence: Synthetic peptide"
GGGCGGGG

SEQ ID NO: 745 - protein, 5 aa, synthetic construct
  REGION 1..5: note = source = /note="Description of Artificial Sequence: Synthetic peptide"
GPNGG

SEQ ID NO: 746 - protein, 5 aa, synthetic construct
  REGION 1..5: note = source = /note="Description of Artificial Sequence: Synthetic peptide"
GGGGS

SEQ ID NO: 747 - protein, 10 aa, synthetic construct
  REGION 1..10: note = source = /note="Description of Artificial Sequence: Synthetic peptide"
GGGGSGGGGS

SEQ ID NO: 748 - protein, 20 aa, synthetic construct
  REGION 1..20: note = source = /note="Description of Artificial Sequence: Synthetic peptide"
GGGGSGGGGSGGGGSGGGGS

SEQ ID NO: 749 - protein, 25 aa, synthetic construct
  REGION 1..25: note = source = /note="Description of Artificial Sequence: Synthetic peptide"
GGGGSGGGGSGGGGSGGGGSGGGGS

SEQ ID NO: 750 - protein, 6 aa, synthetic construct
  REGION 1..6: note = source = /note="Description of Artificial Sequence: Synthetic peptide"
GGEGGG

SEQ ID NO: 751 - protein, 8 aa, synthetic construct
  REGION 1..8: note = source = /note="Description of Artificial Sequence: Synthetic peptide"
GGEEEGGG

SEQ ID NO: 752 - protein, 5 aa, synthetic construct
  REGION 1..5: note = source = /note="Description of Artificial Sequence: Synthetic peptide"
GEEEG

SEQ ID NO: 753 - protein, 4 aa, synthetic construct
  REGION 1..4: note = source = /note="Description of Artificial Sequence: Synthetic peptide"
GEEE

SEQ ID NO: 754 - protein, 6 aa, synthetic construct
  REGION 1..6: note = source = /note="Description of Artificial Sequence: Synthetic peptide"
GGDGGG

SEQ ID NO: 755 - protein, 7 aa, synthetic construct
  REGION 1..7: note = source = /note="Description of Artificial Sequence: Synthetic peptide"
GGDDDGG

SEQ ID NO: 756 - protein, 5 aa, synthetic construct
  REGION 1..5: note = source = /note="Description of Artificial Sequence: Synthetic peptide"
GDDDG

SEQ ID NO: 757 - protein, 4 aa, synthetic construct
  REGION 1..4: note = source = /note="Description of Artificial Sequence: Synthetic peptide"
GDDD

SEQ ID NO: 758 - protein, 21 aa, synthetic construct
  REGION 1..21: note = source = /note="Description of Artificial Sequence: Synthetic peptide"
GGGGSDDSDEGSDGEDGGGGS

SEQ ID NO: 759 - protein, 5 aa, synthetic construct
  REGION 1..5: note = source = /note="Description of Artificial Sequence: Synthetic peptide"
WEWEW

SEQ ID NO: 760 - protein, 5 aa, synthetic construct
  REGION 1..5: note = source = /note="Description of Artificial Sequence: Synthetic peptide"
FEFEF

SEQ ID NO: 761 - protein, 6 aa, synthetic construct
  REGION 1..6: note = source = /note="Description of Artificial Sequence: Synthetic peptide"
EEEWWW

SEQ ID NO: 762 - protein, 6 aa, synthetic construct
  REGION 1..6: note = source = /note="Description of Artificial Sequence: Synthetic peptide"
EEEFFF

SEQ ID NO: 763 - protein, 7 aa, synthetic construct
  REGION 1..7: note = source = /note="Description of Artificial Sequence: Synthetic peptide"
WWEEEWW

SEQ ID NO: 764 - protein, 7 aa, synthetic construct
  REGION 1..7: note = source = /note="Description of Artificial Sequence: Synthetic peptide"
FFEEEFF

SEQ ID NO: 765 - protein, 22 aa, synthetic construct
  REGION 1..22: note = source = /note="Description of Artificial Sequence: Synthetic peptide"
GSGSATGGSGSTASSGSGSATH

SEQ ID NO: 766 - protein, 22 aa, synthetic construct
  REGION 1..22: note = source = /note="Description of Artificial Sequence: Synthetic peptide"
HGSGSATGGSGSTASSGSGSAT

SEQ ID NO: 767 - protein, 19 aa, synthetic construct
  REGION 1..19: note = source = /note="Description of Artificial Sequence: Synthetic peptide"
AEAAAKEAAAKEAAAKAGG

SEQ ID NO: 768 - protein, 18 aa, synthetic construct
  MOD_RES 1: note = Alpha-carboxy-4-aminobutyric acid
  MOD_RES 2: note = [2-(2-Amino-ethoxy)-ethoxy]-acetic acid
  MOD_RES 3: note = [2-(2-Amino-ethoxy)-ethoxy]-acetic acid
  VARIANT 4: note = /replace="D-Arg" or "homo-L-Arginine" or "(S)-5-guanidino-2-(methylamino)pentanoic acid; N-alpha-methylarginine" or "Glu" or " "
  VARIANT 5: note = /replace="D-Arg" or "homo-L-Arginine" or "(S)-5-guanidino-2-(methylamino)pentanoic acid; N-alpha-methylarginine" or "Glu" or " "
  VARIANT 6: note = /replace="D-Gln" or "Glu"
  VARIANT 7: note = /replace="D-Arg" or "homo-L-Arginine" or "(S)-5-guanidino-2-(methylamino)pentanoic acid; N-alpha-methylarginine" or "Lys" or "Glu"
  VARIANT 8: note = /replace="Lys" or "Glu"
  VARIANT 9: note = /replace="D-Arg" or "homo-L-Arginine" or "(S)-5-guanidino-2-(methylamino)pentanoic acid; N-alpha-methylarginine" or "Lys" or "Glu"
  VARIANT 10: note = /replace="Cyclohexylalanine" or "N-alpha-methylleucine" or "Glu"
  VARIANT 11: note = /replace="Lys" or "Glu"
  VARIANT 12: note = /replace="Lys"
  VARIANT 14: note = /replace="Lys"
  VARIANT 15: note = /replace="octahydroindole-2-carboxylic acid"
  VARIANT 16: note = /replace="para-iodophenylalanine" or "norleucine"
  MOD_RES 18: note = 4-chloro-L-phenylalanine
  VARIANT 18: note /replace="(R)-3-([1,1'-biphenyl]-4-yl)-2-aminopropanoic acid" or "4-chloro-D-phenylalanine"
  REGION 1..18: note = misc_feature - /note="Variant residues given in the sequence have no preference with respect to those in the annotations for variant positions"
  REGION 1..18: note = source = /note="Description of Artificial Sequence: Synthetic peptide"
  VARIANT 1: note = source = /note="N-term may be acetyl, acyl, 3-(1,2,3-triazol-4-yl)Alanine (Polyethylene glycol x10), a polyethylene glycol derivative, Tridecanoic acid, or other half-life extension moiety modified, or is absent"
  REGION 1..18: note = source = /note="See specification as filed for detailed description of substitutions and preferred embodiments"
XXXRRQRPRKSHKGKKPF

SEQ ID NO: 769 - protein, 17 aa, synthetic construct
  VARIANT 1: note = /replace="Ornithine" or "D-Ornithine" or "D-Lys" or "beta-lysine" or "beta-D-lysine" or "beta-homolysine" or "beta-D-homolysine" or " "
  VARIANT 2: note = /replace="beta-homophenylalanine" or "beta-phenylalanine" or " "
  VARIANT 3: note = /replace="homo-L-Arginine" or "D-Arg" or "(S)-5-guanidino-2-(methylamino)pentanoic acid; N-alpha-methylarginine" or "(S)-6-guanidino-2-(methylamino)hexanoic acid" or "homoArgininePsi(CH2NH) -reduced amide bond" or "Arg Psi(CH2NH) -reduced amide bond" or "beta-homoarginine" or " "
  VARIANT 4: note = /replace="homo-L-Arginine" or "D-Arg" or "(S)-5-guanidino-2-(methylamino)pentanoic acid; N-alpha-methylarginine" or "(S)-6-guanidino-2-(methylamino)hexanoic acid" or "homoArgininePsi(CH2NH) -reduced amide bond" or "Arg Psi(CH2NH) -reduced amide bond" or "beta-homoarginine" or " "
  VARIANT 5: note = /replace="Leu" or "Asn" or "D-Gln" or "D-Leu" or "pyroglutamic acid" or "beta-homoglutamine" or "beta-homoasparagine" or "alpha-methyl-leucine" or "alpha-methyl-glutamic acid" or "beta-leucine" or "beta-homoleucine"
  VARIANT 6: note = /replace="homo-L-Arginine" or "D-Arg" or "(S)-5-guanidino-2-(methylamino)pentanoic acid; N-alpha-methylarginine" or "(S)-6-guanidino-2-(methylamino)hexanoic acid" or "homoArgininePsi(CH2NH) -reduced amide bond" or "Arg Psi(CH2NH) -reduced amide bond" or "beta-homoarginine"
  VARIANT 7: note = /replace="Sarcosine" or "alpha-amino-isobutyric acid" or "beta-homoproline" or "alpha-methyl-proline" or "octahydroindole-2-carboxylic acid" or "Proline Psi(CH2NH) -reduced amide bond" or "pipecolic acid"
  VARIANT 8: note = /replace="homo-L-Arginine" or "D-Arg" or "(S)-5-guanidino-2-(methylamino)pentanoic acid; N-alpha-methylarginine" or "(S)-6-guanidino-2-(methylamino)hexanoic acid" or "homoArgininePsi(CH2NH) -reduced amide bond" or "Arg Psi(CH2NH) -reduced amide bond" or "beta-homoarginine"
  VARIANT 9: note = /replace="Cyclohexylalanine" or "(S)-3-cyclohexyl-2-(methylamino)propanoic acid" or "Cyclohexylalanine Psi(CH2NH) -reduced amide bond" or "Leucine Psi(CH2NH) -reduced amide bond" or "N-alpha-methylleucine" or "alpha-methyl-leucine" or "beta-leucine" or "beta-homoleucine"
  VARIANT 10: note = /replace="alpha-methyl-serine" or "beta-homoserine" or "Serine Psi(CH2NH) -reduced amide bond" or "Sarcosine" or "beta-alanine"
  VARIANT 11: note = /replace="Ala" or "Val" or "Leu" or "Tyr" or "2-amino-2-ethylbutanoic acid" or "(S)-tert-butylglycine" or "(S)-3-methyl-2-(methylamino)butanoic acid; N-alpha-methylvaline" or "beta-alanine"
  VARIANT 12: note = /replace="(S)-6-amino-2-(methylamino)hexanoic acid; Nalpha-methyllysine" or "beta-homolysine" or "beta-lysine" or "beta-alanine"
  VARIANT 13: note = /replace="Sarcosine" or "alpha-amino-isobutyric acid" or "beta-alanine"
  VARIANT 14: note = /replace="Sarcosine" or "alpha-amino-isobutyric acid" or "beta-homoproline" or "alpha-methyl-proline" or "octahydroindole-2-carboxylic acid" or "indoline-2-carboxylic acid" or "Proline Psi(CH2NH) -reduced amide bond" or "pipecolic acid"
  VARIANT 15: note = /replace="Leu" or "Val" or "Ile" or "methionine oxide" or "norleucine" or "norvaline" or "para-iodophenylalanine"
  VARIANT 16: note = /replace="Sarcosine" or "alpha-amino-isobutyric acid" or "beta-homoproline" or "alpha-methyl-proline" or "octahydroindole-2-carboxylic acid" or "indoline-2-carboxylic acid" or "Proline Psi(CH2NH) -reduced amide bond" or "pipecolic acid"
  VARIANT 17: note = /replace="1,2,3,4-tetrahydroisoquinoline" or "(R)-1,2,3,4-tetrahydroisoquinoline-3-carboxylic acid" or "1,2,3,4-tetrahydroisoquinoline-1-carboxylic acid" or "(R)-1,2,3,4-tetrahydroisoquinoline-1-carboxylic acid" or "4-chloro-L-phenylalanine" or "para-iodophenylalanine" or "4-fluoro-D-phenylalanine" or "4-chloro-D-phenylalanine" or "4-Iodo-D-phenylalanine" or "indoline-2-carboxylic acid" or "2-aminoindane-2-carboxylic acid" or "octahydroindole-2-carboxylic acid" or "(R)-2-amino-2-(2,3-dihydro-1H-inden-2-yl)acetic acid" or "D-Phe" or "3-(1-naphthyl)-D-alanine" or "3-(2-naphthyl)-D-alanine" or "3-(1-naphthyl)alanine" or "3-(2-naphthyl)alanine" or "(R)-3-([1,1'-biphenyl]-4-yl)-2-aminopropanoic acid" or " "
  REGION 1..17: note = misc_feature - /note="Variant residues given in the sequence have no preference with respect to those in the annotations for variant positions"
  REGION 1..17: note = source = /note="Description of Artificial Sequence: Synthetic peptide"
  VARIANT 1: note = source = /note="N-term acyl group or acyl group-conjugation linker modified"
KFRRQRPRLSHKGPMPF

SEQ ID NO: 770 - protein, 4 aa, Homo sapiens
KEEM

SEQ ID NO: 771 - protein, 4 aa, Homo sapiens
KDEL

SEQ ID NO: 772 - protein, 4 aa, Homo sapiens
REEM

SEQ ID NO: 773 - protein, 8 aa, synthetic construct
  VARIANT 1..8: note = misc_feature - /note="This sequence may encompass 1-8 residues, wherein some positions may be absent"
  REGION 1..8: note = source = /note="Description of Artificial Sequence: Synthetic peptide"
GGGGGGGG

What is claimed is:

1. A method for treating a cardiovascular condition in a subject in need thereof comprising administering to the subject an isolated polypeptide comprising the amino acid sequence SEQ ID NO:21, wherein the cardiovascular condition is heart failure or hypertension.

2. The method of claim 1, wherein $dP/dt_{max}$ and/or ejection fraction is increased in the subject following administration of the polypeptide.

3. The method of claim 1, wherein systolic or diastolic function is improved in the subject following administration of the polypeptide.

4. The method of claim 1, wherein the heart failure is heart failure with reduced ejection fraction.

5. The method of claim 1, wherein the heart failure is heart failure with preserved ejection fraction.

6. The method of claim 1, wherein the heart failure is chronic systolic heart failure or chronic diastolic heart failure.

7. The method of claim 1, wherein the heart failure is acute heart failure.

8. The method of claim 1, wherein the cardiovascular condition is hypertension.

9. A method of improving cardiac contractility in a subject having a cardiovascular condition comprising administering to the subject an isolated polypeptide comprising the amino acid sequence SEQ ID NO:21, wherein cardiac contractility is improved in the subject following administration.

10. A method of increasing ejection fraction in a subject having a cardiovascular condition comprising administering to the subject an isolated polypeptide comprising SEQ ID NO:21, wherein the ejection fraction is increased following administration of the polypeptide.

11. A method of increasing ejection fraction in a subject in need thereof comprising administering an isolated polypeptide comprising the amino acid sequence SEQ ID NO: 21 to the subject in need thereof.

12. A method of improving cardiac contractility in a subject in need thereof comprising by administering an isolated polypeptide comprising the amino acid sequence SEQ ID NO: 21, wherein the polypeptide increases dP/dt MAX and/or ejection fraction in the subject following administration.

13. The method of claim 12, wherein the polypeptide improves systolic or diastolic function in the subject following administration.

* * * * *